United States Patent
Jeffs et al.

(10) Patent No.: US 6,750,008 B1
(45) Date of Patent: Jun. 15, 2004

(54) METHODS AND COMPOSITIONS FOR INHIBITION OF MEMBRANE FUSION-ASSOCIATED EVENTS, INCLUDING HIV TRANSMISSION

(75) Inventors: Peter Jeffs, Chapel Hill, NC (US); John William Lackey, Hillsborough, NC (US); Joel Burton Erickson, Durham, NC (US); Mary Katherine Lawless, Raleigh, NC (US); Gene Merutka, Saratoga, CA (US)

(73) Assignee: Trimeris, Inc., Durham, NC (US)

( * ) Notice: Subject to any disclaimer, the term of this patent is extended or adjusted under 35 U.S.C. 154(b) by 0 days.

(21) Appl. No.: 09/350,841

(22) Filed: Jul. 9, 1999

(51) Int. Cl.[7] .................................................. C12Q 1/70

(52) U.S. Cl. ........................ 435/5; 424/188.1; 424/208.1; 530/324; 530/325; 530/326

(58) Field of Search ............................ 435/5; 424/188.1, 424/208.1

(56) References Cited

U.S. PATENT DOCUMENTS

| | | |
|---|---|---|
| 5,141,867 A | 8/1992 | Ivanoff et al. |
| 5,464,933 A | 11/1995 | Bolognesi et al. |
| 5,627,023 A | 5/1997 | Bolognesi et al. |
| 5,656,480 A | 8/1997 | Wild et al. |
| 6,017,536 A | 1/2000 | Barney et al. |

FOREIGN PATENT DOCUMENTS

| | | |
|---|---|---|
| WO | WO 90/07119 | 6/1990 |
| WO | WO 91/09872 | 7/1991 |
| WO | WO 92/22654 | 12/1992 |

OTHER PUBLICATIONS

Wild, C., et al., 1992, "A synthetic peptide inhibitor of human immunodeficiency virus replication: correlation between solution structure and viral inhibition", Proc. Natl. Acad. Sci. USA 89:10537–10541.*

Judice, J. K., et al., 1997, "Inhibition of HIV type 1 Infectivity by constrained α-helical peptides: implications for the viral fusion mechanism", Proc. Natl. Acad. Sci. USA 94:13426–13430.*

Pinilla, C., et al., 1993, "Functional importance of amino acid residues making up peptide antigenic determinants", Mol. Immunol. 30(6):577–585.*

Pease, L. R., et al., 1993, "Amino acid changes in the peptide binding site have structural consequences at the surface of class I glycoproteins", J. Immunol. 150(8):3375–3381.*

Boehncke, W.–H., et al., 1993, "The importance of dominant negative effects of amino acid side chain substitution in peptide–MHC molecule interactions and T cell recognition", J. Immunol. 150(2):331–341.*

Schibli et al. The membrane–proximal tryptophan–rich region of the HIV glycoprotein, gp41, forms a well–defined helix in dodecylphosphocholine micelles. Biochemistry. Aug. 14,; 2001 40(32):9570–8.

Wild et al. A synthetic peptide from HIV–1 gp41 is a potent inhibitor of virus–mediated cell–cell fusion. AIDS Res Hum Retroviruses. 1993 Nov;9(11):1051–3.

(List continued on next page.)

*Primary Examiner*—Laurie Scheiner
*Assistant Examiner*—Jeffrey S. Parkin
(74) *Attorney, Agent, or Firm*—Pennie & Edmonds LLP

(57) ABSTRACT

The present invention relates to peptides which exhibit potent anti-retroviral activity. The peptides of the invention comprise DP178 (SEQ ID:1) peptide corresponding to amino acids 638 to 673 of the HIV-1$_{LAI}$ gp41 protein, and fragments, analogs and homologs of DP178. The invention further relates to the uses of such peptides as inhibitory of human and non-human retroviral, especially HIV, transmission to uninfected cells.

22 Claims, 86 Drawing Sheets

OTHER PUBLICATIONS

Figure 2:
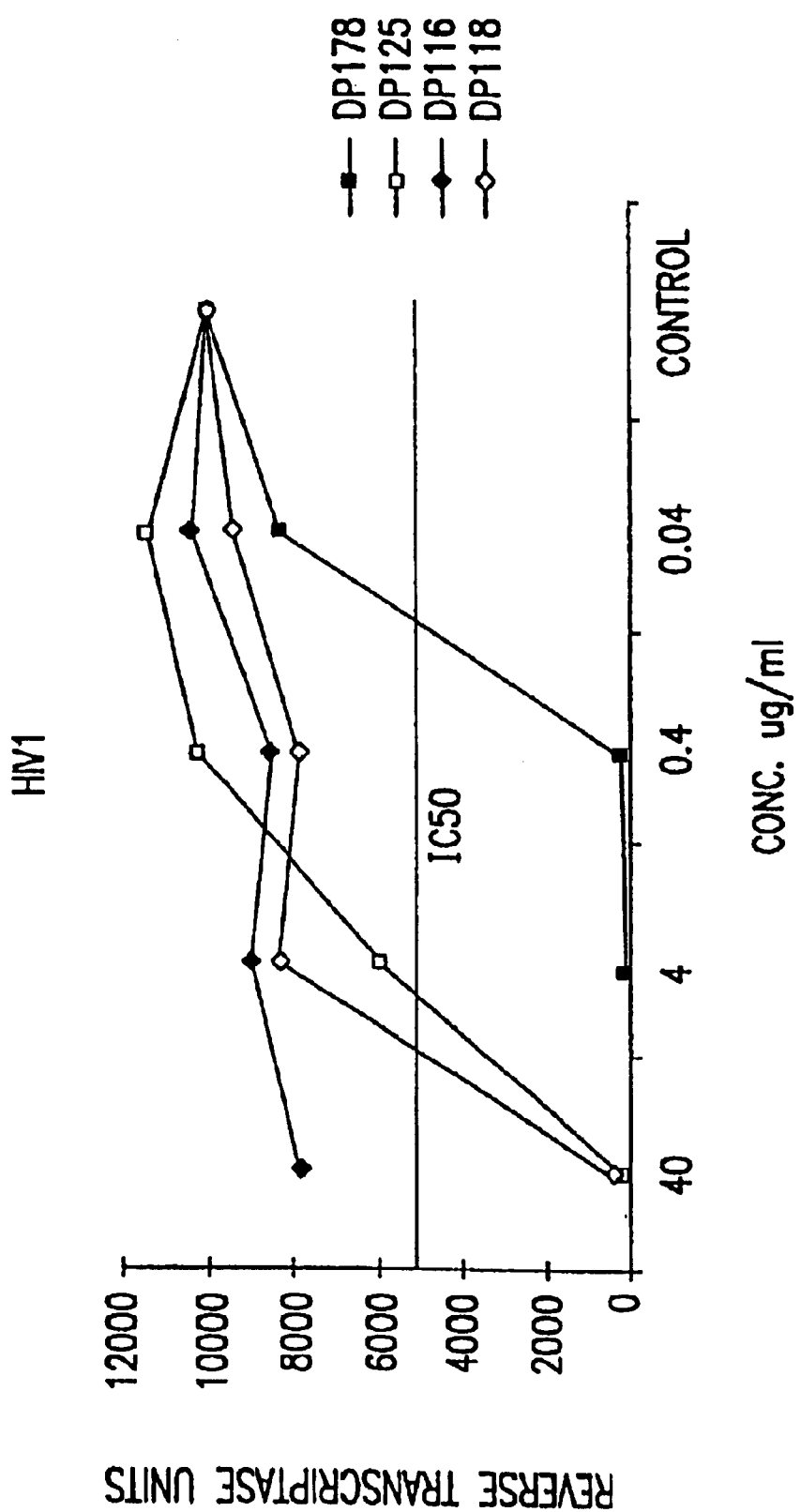

U.S. patent application Ser. No. 08/255,208, Bolognesi et al., filed Jun. 7, 1994.

U.S. patent application Ser. No. 08/470,896, Bolognesi et al., filed Jun. 6, 1995.

U.S. patent application Ser. No. 09/315,304, Barney et al., filed May 4, 1999.

Barin et al., 1985, "Virus Envelope Protein of HTLV–III Represents Major Target Antigen for Antibodies in AIDS Patients", Science 228:1094–1096.

Barnett SW, Murthy KK, Herndier BG, Levy JA, 1994, "An AIDS–like condition induced in baboons by HIV–2", Science. Oct. 28; 266(5185):642–646.

Barré–Sinoussi et al., 1983, Isolation of a T–Lymphotropic Retrovirus from a Patient at Risk for Acquired Immune Deficiency Syndrome (AIDS), Science 220:868–870.

Chen CH, Weinhold KJ, Bartlett JA, Bolognesi DP, Greenberg ML, 1993, "CD8+ T lymphocyte–mediated inhibition of HIV–1 long terminal repeat transcription: a novel antiviral mechanism", AIDS Res Hum Retroviruses. Nov;9(11):1079–1086.

Chen, 1994, "Functional Role of the Zipper Motif Region of Human Immunodeficiency Virus Type I Transmembrane Protein gp41", J. Virol. 68:2002–2010.

Clavel et al., 1986, "Isolation of a New Human Retrovirus from Westa African Patients with AIDS", Science 233:343–346.

Daar et al., 1990, "High Concentrations of Recombinant Soluble CD40 are Required to Neutralize Primary Human Immunodeficiency Virus Type 1 Isolates", Proc. Natl. Acad. Sci USA 87:6574–6579.

Dalgleish et al., 1984, "The CD4 (T4) Antigen is an Essential Component of the Receptor for the AIDS Retrovirus", Nature 312:763–767.

Erickson et al., 1990, "Design, Activity and 2.8 ÅCrystal Structure of a C2 Symmetric Inhibitor Complexed to HIV–1 Protease", Science 249:527–533.

Gallo et al., 1984, "Frequent Detection and Isolation of Cytopathic Retroviruses (HTLV–III) from Patients with AIDS and at Risk for AIDS", Science 224:500–503.

Goff S, Traktman P, Baltimore D, 1981, "Isolation and properties of Moloney murine leukemia virus mutants: use of a rapid assay for release of virion reverse transcriptase", J. Virol. Apr;38(1):239–48.

Guyader et al., 1987, "Genome Organization and Transactivation of the Human Immunodeficiency Virus Type 2", Nature 326:662–669.

Hammarskjöld and Rekosh, 1989, "The Molecular Biology of the Human Immunodeficiency Virus", Biochem. Biophys. Acta 989:269–280.

Kahn et al., 1990, "The Safety and Pharmacokinetics of Recombinant Soluble CD4 (rCD4) in Subjects with the Acquired Immunodeficiency Syndrome (AIDS) and AIDS–Related Complex", Ann. Int. Med. 112:254–261.

Klatzmann et al., 1984, "T–Lymphocyte T4 Molecule Behaves as the Receptor for Human Retrovirus LAV", Nature 312:767–768.

Lam et al., 1991, "A New Type of Synthetic Peptide Library for Identifying Ligand–Binding Activity", Nature 354:82–84.

Langlois AJ, Weinhold KJ, Matthews TJ, Bolognesi DP, 1991, "In vitro assays for detecting neutralizing and fusion-inhibiting antibodies to SIVMAC251", AIDS Res Hum Retroviruses. Aug;7(8):713–720.

Lupas et al., 1991, "Predicting Coiled Coils from Protein Sequences", Science 252:1162–1165.

Maddon et al., 1986, "The T4 Gene Encodes the AIDS Virus Receptor and is Expressed in the Immune System and the Brain", Cell 47:333–348.

Malim et al., 1988, "Immunodeficiency Virus rev trans–Activator Modulates the Expression of the Viral Regulatory Genes", Nature 335:181–183.

Matthews TJ, Weinhold KJ, Lyerly HK, Langlois AJ, Wigzell H, Bolognesi DP, 1987, "Interaction between the human T–cell lymphotropic virus type IIIB envelope glycoprotein gp120 and the surface antigen CD4: role of carbohydrate in binding and cell fusion", Proc Natl Acad Sci USA. Aug; 84(15):5424–5428.

McDougal et al., 1986, "Binding of HTLV–III/LAV to T4+ T Cells by a Complex of the 110k Viral Protein and the T4 Molecule", Science 231:382–385.

Mitsuya et al., 1990, "Molecular Targets for AIDS Therapy", Science 249:1533–1544.

Mitsuya et al., 1991, "Targeted Therapy of Human Immunodeficiency Virus–Related Disease", FASEB J. 5:2369–2381.

Schooley et al., 1990, "Recombinant Soluble CD4 Therapy in Patients with the Acquired Immune Deficiency Syndrome (AIDS) and AIDS–Related Complex. A Phase I–II Escalating Dosage Trial", Ann. Int. Med. 112:247–253.

Smith et al., 1987, "Blocking of HIV–1 Infectivity by a Soluble, Secreted Form of the CD4 Antigen", Science 238:1704–1707.

Songyang et al., 1993, "SH2 Domains Recognize Specific Phosphopeptide Sequences", Cell 72:767–778.

Teich et al., 1984, "Pathogenesis of Lentivirus", RNA Tumor Viruses, Weiss et al., eds., CSH Press, pp. 949–956.

White, 1992, "Membrane Fusion", Science 258:917–924.

Wild et al., 1992, "A Synthetic Peptide Inhibitor of Human Immunodeficiency Virus Replication: Correlation between Solution Structure and Viral Inhibition", Proc. Natl. Acad. Sci USA 89:10537–10541.

Willey RL, Smith DH, Lasky LA, Theodore TS, Earl PL, Moss B, Capon DJ, Martin MA, 1988, "In vitro mutagenesis identifies a region within the envelope gene of the human immunodeficiency virus that is critical for infectivity", J. Virol. Jan;62(1):139–47.

Xu et al., 1991, "Epitope Mapping of Two Immunodominant Domains of gp41, the Transmembrane Protein of Human Immunodeficiency Virus Type 1, Using Ten Human Monoclonal Antibodies", J. Virol. 65:4832–4838.

Yarchoan et al., 1989, "Phase I Study of the Administration of Recombinant Soluble CD4 (rCD4) by Continuous Infusion to Patients with AIDS or ARC", Proc. Vth Int. Conf. on AIDS, p. 564, MCP 137.

Chen CH, Matthews TJ, McDanal CB, Bolognesi DP, Greenberg ML. A molecular clasp in the human immunodeficiency virus (HIV) type 1 TM protein determines the anti–HIV activity of gp41 derivatives: implication for viral infection. J Virol. 1995 Jun;69(6):3771–7.

\* cited by examiner

| | | |
|---|---|---|
| HIV1LAI (DP-178; SEQ ID NO.:15) | | YTSLIHSLIEESQNQQEKNEQELLELDKWASLWNWF |
| HIV1SF2 (DP-185; SEQ ID NO.:1357) | | YTNTIYTLLEESQNQQEKNEQELLELDKWASLWNWF |
| HIV1RF (SEQ ID NO.:1358) | | YTGIIYNLLEESQNQQEKNEQELLELDKWANLWNWF |
| HIV1MN (SEQ ID NO.:1544) | | YTSLIYSLLEKSQTQQEKNEQELLELDKWASLWNWF |
| HIV2ROD (SEQ ID NO.:1545) | | LEANISKSLEQAQIQQEKNMYELQKLNSWDIFGNWF |
| HIV2NIHZ (SEQ ID NO.:1546) | | LEANISQSLEQAQIQQEKNMYELQKLNSWDVFTNWL |
| DP180 (SEQ ID NO.:55) | | SSESFTLLEQWNNWKLQLAEQWLEQINEKHYLEDIS |
| DP118 (SEQ ID NO.:904) | | QQLLDVVKRQQEMLRLTVWGTKNLQARVTAIEKYLKDQ |
| DP125 (SEQ ID NO.:496) | | CGGNNLLRAIEAQQHLLQLTVWGIKQLQARILAVERYLKDQ |
| DP116 (SEQ ID NO.:1547) | | LQARILAVERYLKDQQQ |

FIG.1

Number of Syncytia/well: concentration in μg/ml (micrograms/ml)

| DP178 | 10 | 5 | 1 | 0.2 | 0.1 | 0.05 | 0.025 | 0.0125 | Control |
|---|---|---|---|---|---|---|---|---|---|
| *Syncytia* | | | | | | | | | |
| HIV1LAI | 0 | 0 | 0 | 0 | 0 | 0 | 0 | 0 | 67 |
| HIV1MN | 0 | 0 | 0 | 0 | 0 | ND | ND | ND | 34 |
| HIV1RF | 0 | 0 | 0 | 0 | 0 | ND | ND | ND | 65 |
| HIV1SF2 | 0 | 0 | 0 | 0 | 0 | ND | ND | ND | 58 |

| DP125 | 10 | 5 | 1 | 0.2 | 0.1 | 0.05 | 0.025 | 0.0125 | Control |
|---|---|---|---|---|---|---|---|---|---|
| *Syncytia* | | | | | | | | | |
| HIV1LAI | 0 | 0 | 54 | 69 | 80 | 75 | 79 | 82 | 67 |
| HIV1MN | 0 | 0 | 30 | 36 | ND | ND | ND | ND | 34 |
| HIV1RF | 0 | 0 | 67 | 63 | ND | ND | ND | ND | 65 |
| HIV1SF2 | 0 | 0 | 9 | 66 | ND | ND | ND | ND | 58 |

| DP116 | 10 | 5 | 1 | 0.2 | 0.1 | 0.05 | 0.025 | 0.0125 | Control |
|---|---|---|---|---|---|---|---|---|---|
| *Syncytia* | | | | | | | | | |
| HIV1LAI | 75 | ND | ND | ND | ND | ND | ND | ND | 67 |
| HIV1MN | 35 | ND | ND | ND | ND | ND | ND | ND | 34 |
| HIV1RF | 81 | ND | ND | ND | ND | ND | ND | ND | 65 |
| HIV1SF2 | 81 | ND | ND | ND | ND | ND | ND | ND | 58 |

FIG.4A

| DP180 | 40 | 20 | 10 | 5 | 2.5 | 1.25 | 0.625 | 0.3125 | Control |
|---|---|---|---|---|---|---|---|---|---|
| *Syncytia* | | | | | | | | | |
| HIV1LAI | 50 | >45 | >45 | >45 | >45 | >45 | >45 | >45 | 58 |
| DP185 | 40 | 20 | 10 | 5 | 2.5 | 1.25 | 0.625 | 0.3125 | Control |
| *Syncytia* | | | | | | | | | |
| HIV1LAI | 0 | 0 | 0 | 0 | 0 | 0 | 0 | ND | 60 |

FIG.4B

| | HIV1 | | | | | | | |
|---|---|---|---|---|---|---|---|---|
| | Number of Syncytia/well: concentration in ng/ml (nanograms/ml) | | | | | | | |
| DP178 | 20 | 10 | 5 | 2.5 | 1.25 | 0.625 | 0.3125 | Control |
| Syncytia HIV1 | 0 | 0 | 0 | 0 | 0 | 14 | 20 | 48 |
| DP116 | 20 | 10 | 5 | 2.5 | 1.25 | 0.625 | 0.3125 | Control |
| Syncytia HIV1 | ND | 48 | ND | ND | ND | ND | ND | ND |
| | HIV2 | | | | | | | |
| | Number of Syncytia/well: concentration in µg/ml (micrograms/ml) | | | | | | | |
| DP178 | 20 | 10 | 5 | 2.5 | 1.25 | 0.625 | 0.3125 | Control |
| Syncytia HIV2 | 50 | 54 | 55 | 57 | 63 | 77 | 78 | 76 |
| DP116 | 20 | 10 | 5 | 2.5 | 1.25 | 0.625 | 0.3125 | Control |
| Syncytia HIV2 | ND | 58 | ND | ND | ND | ND | ND | ND |

FIG.5

| Sequence | | | | Positions | | | | | Motifs |
|---|---|---|---|---|---|---|---|---|---|
| | A | D | A | D | A | D | A | D | |
| GCN4 (gcn4 yeast) | MKQ | LEDKV | EELLSKNY | HLENEVA | RLKKL | | | | [LMNV] {CFGIMPTW} |
| C-FOS (fos_human) | TDT | LQAET | DQLEDEKS | ALQTEIA | NLLKE | | | | [IKLT] {CFGHIMPRVWY} |
| C-JUN (tap1_human) | IAR | LEEKV | KTLKAQNS | ELASTAN | MLREQ | | | | [AILNV] {CDFGHILPVWY} |
| C-MYC (myo_human) | EQK | LISEE | DLLEKRRE | QLKHKLE | QLRNS | | | | [ELR] {ACFGMPVWY} |
| FLU LOOP 36 | IEK | TNEKF | HQIEKEFS | EVEGRII | QDLEKY | | | | [FILTV] {ACFLMPTVW} |

FIG.12

FIG.13

| Sequence | Positions | | | | | | | | | | | | | | Parent Motif | | Hybrid Motif | |
|---|---|---|---|---|---|---|---|---|---|---|---|---|---|---|---|---|---|---|
| | A | D | A | D | A | D | A | D | A | D | A | D | A | D | | | | |
| GCN4 (gcn4 yeast) | M K Q L | E D K | V E E L | L S K | N Y H L | E N E | V A R | L K K L | | | | | | | [LMNV] | {CFGIMPTW} | | |
| DP-107 (env_hv1bru)L1=0 | N

| Sequence | Positions | | | | | | | | | | | Parent Motif | Hybrid Motif |
|---|---|---|---|---|---|---|---|---|---|---|---|---|---|
| | A | D | A | D | A | D | A | D | A | D | | | |
| GCN4 (gcn4 yeast) | M K | Q L E D K | V E | E L L | S K N Y | H L E N E | V A R | L K K L | | | | [LMNV] {CFGILMPTW} | |
| DP-178 (env_hv1bru)Y1=A | Y T | S L I H | S L | I E E S | Q N Q | Q E K N | E Q E | L L E L D K | W A S | L W N W | | [EKLQY] {ACFGLMPR

| Sequence | Positions | | | | | | | | | | | Parent Motif | Hybrid Motif |
|---|---|---|---|---|---|---|---|---|---|---|---|---|---|
| | A | D | A | D | A | D | A | D | A | D | A | | |
| DP-107 (env_hv1bru)L1=0 | N | N | L | L | R | A | I | E | A | Q | Q | H L L Q L T V W G I K Q L Q A R I L A V E R Y L K D Q | [ILQTV] [CDFIMPST] |
| DP-107 (env_hv1bru)L2=0 | N | N | L | L | R | A | I | E | A | Q | Q | H L L Q L T V W G I K Q L Q A R I L A V E R Y L K D Q | [EKLNQV] [CFKMPS] |
| DP-178 (env_hv1bru)Y1=A | Y | T | S | L | I | H | S | L | I | E | E | S Q N Q Q E K N E Q E L L E L D K W A S L W N W F | [EFKLQWY] [CFGMPRVY] |
| DP-178 (env_hv1bru)Y1=0 | Y | T | S | L | I | H | S | L | I | E | E | S Q N Q Q E K N E Q E L L E L D K W A S L W N W F | [EFILNQSMY] [CFGMPRVY] | [EFIKLNQSTVWY] [CFMP] |
| FLU LOOP 36 | I | E | K | T | N | E | K | F | H | Q | I | E K E F S E V E G R I Q D L E K Y | [FILTV] [ACFLMPTVW] | |

FIG.16

| Sequence | Positions | | | | | | | | | | | | | | | | Parent Motif | Hybrid Motif |
|---|---|---|---|---|---|---|---|---|---|---|---|---|---|---|---|---|---|---|
| | A | D | A | D | A | D | A | D | A | D | A | | | | | | | |
| GCN4 (gcn4 yeast) | M K Q L E D K V E E L L S K N Y H L E N E V A R L K K L | | | | | | | | | | | | | | | | | |
| DP-107 (env_hv1bru)L1=D | N N L L R A I E A Q Q H L L Q L T V W G I K Q L Q A R I L A V E R Y L K D Q | | | | | | | | | | | | | | | | [LIANV] [CFGIMPTW] [ILQTV] [CDFIMPST] [E

FIG. 18

| Sequence | A | D | A | D | A | D | A | D | A | D | A | D | Parent Motif |
|---|---|---|---|---|---|---|---|---|---|---|---|---|---|
| GCN4 (gcn4_yeast) | M | K Q L | E D K V | E E L L | S K N Y | H L E N E V | A R L K K L |  |  |  |  |  | [LMNV] {CFGIMPTW} |
| DP-107 (env_hv1bru)L1=D | N | N L L | R A I E | A Q Q H | L L Q L | T V W G I K | Q L Q A R I | L A V E R Y | L K D Q |  |  |  | [ILQTV] {CDFIMPST} |
| DP-107 (env_hv1bru)L2=D | N | N L L | R A I E | A Q Q H | L L Q L | T V W G I K | Q L Q A R I | L A V E R Y | L K D Q |  |  |  | [EKLNQV] {CFKMPS} |
| DP-178 (env_hv1bru)Y1=A | Y | T S L | I H S L | I E E S | Q N Q Q | E K N E | Q E L L E L | D K W A S L | W N W F |  |  |  | [EFKLQMY] {CFGMPRVY} |
| DP-178 (env_hv1bru)Y1=D | Y | T S L | I H S L | I E E S | Q N Q Q | E K N E | Q E L L E L | D K W A S L | W N W F |  |  |

P—[LIV]—{P}(6)—[LIV]
P—{P}(1)—[LIV]—{P}(6)—[LIV]
P—{P}(2)—[LIV]—{P}(6)—[LIV]
P—{P}(3)—[LIV]—{P}(6)—[LIV]
P—{P}(4)—[LIV]—{P}(6)—[LIV]
P—{P}(5)—[LIV]—{P}(6)—[LIV]
P—{P}(6)—[LIV]—{P}(6)—[LIV]
P—{P}(7)—[LIV]—{P}(6)—[LIV]
P—{P}(8)—[LIV]—{P}(6)—[LIV]
P—{P}(9)—[LIV]—{P}(6)—[LIV]
P—{P}(10)—[LIV]—{P}(6)—[LIV]
P—X(1,12)—[LIV]—{P}(6)—[LIV]
P—X(13,23)—[LIV]—{P}(6)—[LIV]

FIG. 19

```
                Fusion          ▼ALLMOTI5▼
                Peptide                                              ◆107x178x4◆
           ▼.......FLGFLG   A AGSTMGARSM TLTVQARQ   ◆LL SGIVQQQ   DP107-NNL
```

*LRAIEAQQHL LQLTVWGIKQ LQARILAVER YLKDQ-DP107*   QLLG◆▼   I WGC

```
                                                      ◆107x178x4◆
              ▼ALLMOTI5▼                             *LVS Coiled-Coil*
    SGKLICT TAVP  ▼WNASWS NKSLEQIWNN MTWM  *E  ◆WDREI NN  DP178=
```

*YTSLIHSL IEESQNQQEK NEQELLELDK*   *WASLWNWF-DP178*   NI

```
                ◆Transmembrane Region◆
    TNWLWYIK◆   ◆IT IMIVGGLVGL RIVFAVLSIV   NRVRQGYS▼   PL
```

```
               ◆P23LZIPC◆
    SFQTHLPTPR GPDR   ◆PEGIEE EGGERDRDRS IRLVNGSLAL IWDDLRSL◆   CL
```

```
       ▼ALLMOTI5▼         ◆107x178x4◆
    F  ▼SYHRLRDLL LIVTRIVELL GRRGW   ◆EALKY WWNLLQYWSQ
```

*ELKNSAVSLL NAT*◆   AIAVAEG TDRVIEVVQG A▼   CRAIRHIPR

RJRQGLERIL L

FIG. 20

```
         Fusion         ▼ALLMOTI5▼
         Peptide                  ♦107x178x4♦
▼........FLGFL    LGVGSAIAS GVA   ♦YSKVLHLEGEVNKIKSA

♦PI&12LZIPC♦
LLSTNKAVVS LSNGVSVLTS KVLDLKNYID KQ♦▼  LL    ♦PIVNKQ

♦107x178x4♦
SC  ♦SISNIETVI♦  EFQQKNNRLLEITREFSVNAG♦  VTTPVSTMLTNSELLSL

♦PI&12LZIPC♦
             ▼ALLMOTI5▼
INDM ♦PI ▼TNDQ KKLMSNNVQI V♦  RQQSYSI♦  MS IIKEEVLAYV

VQ▼   LPLYGVID TPCWKLHTSP LCTTNTKEGS NICLTRTDRG WYCDNAGSVS

FFPQAETCKV QSNRVFCDTM NSLTLPSEIN LCNVDIFNPK

YDCKIMTSKT DVSSSVITSL GAIVSCYGKT KCTASNKNRG

IIKTFSNGCDYVSNKGMDTV SVGNTLYYVN KQEGKSLYVK G

♦P7, 12, & 23LZIPC♦
              ♦107x178x4♦                ▼ALLMOTI5▼
EPIINFYDPLVF ♦PSDE ♦FDASISQVNEKINQSLAF ▼I♦ RKSDELL♦

♦Transmembrane Region♦
IINVNA♦  GK STTN ♦IMITTI IIVIIVILLS LIAVGLLLY▼ C♦

KARSTPVTLS KDQLSGINNI AFSN
```

FIG. 21

Fusion
Peptide      ♥ALLMOTI5♥      ♠107x178x4♠
.......FLGFLG   ♥AAGTA MGAAA   ♠TALTVQSQHLLAGILQQQKNLLAAV ♠107x178x4♠
EAQ♠  QQM  ♠LKLTIWGVKNLNARVTALEKYLEDQARLN♠  AWG♥  CA

*LVS Coiled-Coil*
                  ♥ALLMOTI5♥   ♠107x178x4♠
WKQVCHTTVP WQWNNRTPDW ♥NNMT *WLE ♠WERQISYLEGNIT ♠107x178x4♠
TQLEEARAQEEKNLD♠ AYQKLSS* WSDFWSW♥ FDF ♠SKWLN ♦ILK ♦Transmembrane Region♦
IGFLDVLGIIGLRLLYTV♦ YS♠ CIARVRQGYS PLSPQIHIHP WKGQPDNAEG

PGEGGDKRKN SSEPWQKESG TAEWKSNWCK RLTNWCSISS IWLYNS

♥ALLMOTI5♥
♥CLTL LVHLRSAFQY IQYGLGELKA AAQEAVVALA RLAQNAGYQIWL♥

ACRSAYRA IINSPRRVRQ GLEGILN

FIG. 22

```
    Fusion                                            ♦107x178x4♦
    Peptide     ♥ALLMOTI5♥                            *LVS Coiled-Coil*
.......EAG      ♥VVL    AGVALGVATA AQITAGIALHQ ♦*SNLNAQAIQ
```

SLRTSLEQSNKAIEEIREATQETVIA* YQGVQDY♦ VNNEL♥ VP

```
                                             ♥ALLMOTI5♥
                                             ♦107x178x4♦
                                        ♦P6 & 12LZIPC♦
AMQHMSCELVGQRLGLRLLRYYTELLSIFGPSLRD ♦PISA ♦♥EISIQALIYAL
```

GGEIIKILEKLGYSGSD♦ MIAILESRGIKTKI♥ THVDLPGKF ILSISY

♦P1 & 12LZIPC♦
♦PTLSEVKGVIVHRLEAV♦ SYNIGSQEWYTTVPRYIATNGYLISNFDESSCVFVS

ESAICSQNSL YPMSPLLQQC IRGDTSSCAR TLVSGTMGNK FILSKGNIVA

NCASILCKCY STSTIINQSP DKLLTFIASD TCPLVEIDGA TIQVGGRQYP

```
                      *LVS Coiled-Coil*
                      ♥ALLMOTI5♥
                  ♦P12 & 23LZIPC♦
DMVYEGKVAL G  ♦PAISLD  ♥RL*DVGTNLGNALKKLDDAKVLI♦
```

```
                            ♦Transmembrane Region♦
DSS♦  NQILETVR RS♥*  SFN    ♦FGSLL SVPILSCTAL ALLLLIYCC♦
```

K RRYQQTLKQH TKVDPAFKPD LTGTSKSYVR SL

FIG. 23

Fusion    ▼ALLMOTI5▼
Peptide                                                                          ▲107x178x4▲
▼........FIGAI   IGSVALGVA TAAQITAASA LIQANQNAAN  ▲ILRLKESITA

TIEAVHEVTDGLSQLAVA▲  VG KM▼  QQFVNDQFNNTAQELDCIKITQQV

▼ALLMOTI5▼
GVELNLYLTELTTV FGPQITSPAL  ▼TQLTIQALYNAGGNMDYLLTKLGVG

✦P1 & 12LZIPC✦
NNQLSSLIGSGLIT GN▼ ✦PILYDSQT QLLGIQVTLP SVGNLNNMRATYLET

LSVST TKGFASALVP KVVTQVGSVI EELDTSYCIE TDLDLYCTRI VTFPMSPGIY

SCLNGNTSAC MYSKTEGALT TPYMTLKGSV IANCKMTTCR CADPPGIISQ

▼ALLMOTI5▼
▲107x178x4▲
NYGEAVSLID RHSCN  ▲▼VLSLD GITLRLSGEF DATYQKNISI LDSQVIVTG

*LVS Coiled-Coil*                                                                 ✦Trans-
*N LDISTELGNV NNSISNALDK LEESNSKLDK VNVKLTSTSA ♦LIT* YIA membrane Region♦

LTAISLVCGILSLV♥♠ LACYLMY♦ KQKAQQKTLLWLGNNTLGQMRATTKM

FIG. 24

```
Fusion           ▼ALLMOTI5▼
Peptide      ★107x178x4★      *LVS Coiled-Coil*
.......FFGGY    ★IG  ▼TIALG  *VATSAQITAAVALVEAKQARSDIEKLKE
```

AIRDTNKAVQSVQSSIGNLIVAIKSVQ*  DYVNKE▼★   IVPSIARLGCEAAG

```
           ▼ALLMOTI5▼
           ★107x178x4★
LQLGIALTQH ★▼YSELTNIFGDNIGSLQEKGIKLQGIASLYRTNITE▼★
```

```
                                              ★P5 & 12LZIPC★
IFTTSTVDKYDIYDLLFTESIKVRVIDVDLNDYSITLQVRL  ★PLLTRLLNTQFYR
```

VDSISYNI★  QNREWYI★  PLPSHIMTKGAFLGGADVKECIEAFSSYIC

PSDPGFVLNHEMESCLSGNISQCPRTVVKSDIVPRYAFVNGGVVANCITT

TCTCNGIGNRINQPPDQGVKIITHKECNTIGINGMLFNTNKEGTLAFYTP

```
              ▼ALLMOTI5▼
            ★107x178x4★
         ★P6 & 23LZIPC★
NDITLNNSVALD  ★PIDI ★SIELN  ▼KAKSDLEESKEWI★ RRSNQKL.★
```

```
           ◆Transmembrane Region◆
DSIGNWHQSSTT  ◆IIIV★ LIM IIILFIINVT II◆   IIAVKYY▼ R
```

IQKRNRVDQN DKPYVLTNK

FIG. 25

Fusion
Peptide
.......GLFGAI AGFIENGWEGMIDGWYGFRHQNSEGTG

♠107x178x4♠
♥ALLMOTI5♥
*LYS Coiled-Coil*
*Q ♥AADLKST ♠QAAIDQINGKLNRVIEKTNEKFHQIEKEFSEVEGRIQ

DLEKYVEDTKIDL* WSYNAELLVALENQHTI♠ DLT♥ DSEMNKLFEKTR

RQLRENAEEMGNGCFKIYHKCDNACIESIRNGTYDHDVYRDEALNNRFQIKG

VELKSGYKDWILWISFAISCFLLCVVLLGFIMWACQRGNIRCNICI

| RSV F2 | AV | FUSION ARRAY PURIFIED IC50 (XTT) (μg/ml) | CD |
|---|---|---|---|
| T-142 | ++ | 39 | ++ |
| T-143 | ++ | 31 | +++ |
| T-144 | + | 114 | ++ |
| T-145 | ++ | 40 | + |
| T-146 | - | 281 | - |
| T-147 | - | 204 | - |
| T-148 | - | 354 | - |
| T-149 | - | 336 | - |
| T-150 | - | 342 | + |
| T-151 | +/- | 116 | + |
| T-152 | +/- | 117 | ++ |
| T-153 | - | 280 | + |
| T-154 | +/- | 118 | ++ |
| T-155 | - | 253 | + |

FIG.27B

| RSV PEPTIDE # | Sequence | AVG. IC50 (XTT) UG/ML |
|---|---|---|
| T-22 | IELSNIKENKCNGTDAKVKLIKQELDKYKNAVTELQLLMQST | >500 |

| RSV DP-107-LIKE REGION (F1) | | | | | | | | | | | | | | | | | | | | |
|---|---|---|---|---|---|---|---|---|---|---|---|---|---|---|---|---|---|---|---|---|
| RSV | A | S | G | V | A | V | S | K | V | L | H | L | E | G | E | V | N | K | I | A | L | L | S | T | N | K | A | V | V | S | L | S | N | G | V | S | V | L | T | S | K | V | L | D | L | K | N | Y | I | D | K | Q | L | L |
| F1-107 | A | S | G | V | A | V | S | K | V | L | H | L | E | G | E | V | N | K | I | A | L | L | S | T | N | K | A | V | V | S | L | S | N | G | V | S | V | L | T | S | K | V | L | D | L | K | N | Y | I | D | K | Q | L | L |
| T-120 |   | S | G | V | A | V | S | K | V | L | H | L | E | G | E | V | N | K | I | A | L | L | S | T | N | K | A | V | V | S | L | S | N | G |   |   |   |   |   |   |   |   |   |   |   |   |   |   |   |   |   |   |   |   |
| T-121 |   |   | G | V | A | V | S | K | V | L | H | L | E | G | E | V | N | K | I | A | L | L | S | T | N | K | A | V | V | S | L | S | N | G | V |   |   |   |   |   |   |   |   |   |   |   |   |   |   |   |   |   |   |   |
| T-122 |   |   |   | V | A | V | S | K | V | L | H | L | E | G | E | V | N | K | I | A | L | L | S | T | N | K | A | V | V | S | L | S | N | G | V | S |   |   |   |   |   |   |   |   |   |   |   |   |   |   |   |   |   |   |
| T-123 |   |   |   |   | A | V | S | K | V | L | H | L | E | G | E | V | N | K | I | A | L | L | S | T | N | K | A | V | V | S | L | S | N | G | V | S | V |   |   |   |   |   |   |   |   |   |   |   |   |   |   |   |   |   |
| T-124 |   |   |   |   |   | V | S | K | V | L | H | L | E | G | E | V | N | K | I | A | L | L | S | T | N | K | A | V | V | S | L | S | N | G | V | S | V | L |   |   |   |   |   |   |   |   |   |   |   |   |   |   |   |   |
| T-125 |   |   |   |   |   |   | S | K | V | L | H | L | E | G | E | V | N | K | I | A | L | L | S | T | N | K | A | V | V | S | L | S | N | G | V | S | V | L | T |   |   |   |   |   |   |   |   |   |   |   |   |   |   |   |
| T-126 |   |   |   |   |   |   |   | K | V | L | H | L | E | G | E | V | N | K | I | A | L | L | S | T | N | K | A | V | V | S | L | S | N | G | V | S | V | L | T | S |   |   |   |   |   |   |   |   |   |   |   |   |   |   |
| T-127 |   |   |   |   |   |   |   |   | V | L | H | L | E | G | E | V | N | K | I | A | L | L | S | T | N | K | A | V | V | S | L | S | N | G | V | S | V | L | T | S | K |   |   |   |   |   |   |   |   |   |   |   |   |   |
| T-128 |   |   |   |   |   |   |   |   |   | L | H | L | E | G | E | V | N | K | I | A | L | L | S | T | N | K | A | V | V | S | L | S | N | G | V | S | V | L | T | S | K | V |   |   |   |   |   |   |   |   |   |   |   |   |
| T-129 |   |   |   |   |   |   |   |   |   |   | H | L | E | G | E | V | N | K | I | A | L | L | S | T | N | K | A | V | V | S | L | S | N | G | V | S | V | L | T | S | K | V | L |   |   |   |   |   |   |   |   |   |   |   |
| T-130 |   |   |   |   |   |   |   |   |   |   |   | L | E | G | E | V | N | K | I | A | L | L | S | T | N | K | A | V | V | S | L | S | N | G | V | S | V | L | T | S | K | V | L | D |   |   |   |   |   |   |   |   |   |   |
| T-131 |   |   |   |   |   |   |   |   |   |   |   |   | E | G | E | V | N | K | I | A | L | L | S | T | N | K | A | V | V | S | L | S | N | G | V | S | V | L | T | S | K | V | L | D | L |   |   |   |   |   |   |   |   |   |
| T-132 |   |   |   |   |   |   |   |   |   |   |   |   |   | G | E | V | N | K | I | A | L | L | S | T | N | K | A | V | V | S | L | S | N | G | V | S | V | L | T | S | K | V | L | D | L | K |   |   |   |   |   |   |   |   |
| T-133 |   |   |   |   |   |   |   |   |   |   |   |   |   |   | E | G | E | V | N | K | I | A | L | L | S | T | N | K | A | V | V | S | L | S | N | G | V | S | V | L | T | S | K | V | L | D | L | K | N |   |   |   |   |   |
| T-134 |   |   |   |   |   |   |   |   |   |   |   |   |   |   |   |   | G |   | E | V | N | K | I | A | L | L | S | T | N | K | A | V | V | S | L | S | N | G | V | S | V | L | T | S | K | V | L | D | L | K | N | Y |   |   |
| T-135 |   |   |   |   |   |   |   |   |   |   |   |   |   |   |   |   |   |   |   |   | N | K | I | A | L | L | S | T | N | K | A | V | V | S | L | S | N | G | V | S | V | L | T | S | K | V | L | D | L | K | N | Y | I |   |
| T-136 |   |   |   |   |   |   |   |   |   |   |   |   |   |   |   |   |   |   |   |   |   | K | I | A | L | L | S | T | N | K | A | V | V | S | L | S | N | G | V | S | V | L | T | S | K | V | L | D | L | K | N | Y | I | D |
| T-137 |   |   |   |   |   |   |   |   |   |   |   |   |   |   |   |   |   |   |   |   |   |   | I | A | L | L | S | T | N | K | A | V | V | S | L | S | N | G | V | S | V | L | T | S | K | V | L | D | L | K | N | Y | I | D | K |
| T-138 |   |   |   |   |   |   |   |   |   |   |   |   |   |   |   |   |   |   |   |   |   |   |   | A | L | L | S | T | N | K | A | V | V | S | L | S | N | G | V | S | V | L | T | S | K | V | L | D | L | K | N | Y | I | D | K | Q |
| T-139 |   |   |   |   |   |   |   |   |   |   |   |   |   |   |   |   |   |   |   |   |   |   |   |   | L | L | S | T | N | K | A | V | V | S | L | S | N | G | V | S | V | L | T | S | K | V | L | D | L | K | N | Y | I | D | K | Q | L |
| T-140 |   |   |   |   |   |   |   |   |   |   |   |   |   |   |   |   |   |   |   |   |   |   |   |   |   | L | S | T | N | K | A | V | V | S | L | S | N | G | V | S | V | L | T | S | K | V | L | D | L | K | N | Y | I | D | K | Q | L |
| T-141 |   |   |   |   |   |   |   |   |   |   |   |   |   |   |   |   |   |   |   |   |   |   |   |   |   |   | S | T | N | K | A | V | V | S | L | S | N | G | V | S | V | L | T | S | K | V | L | D | L | K | N | Y | I | D | K | Q | L | L |

FIG.27D

| RSV | AV | FUSION ASSAY PURIFIED IC50 XTT (μg/ml) | CD |
|---|---|---|---|
| F-107 | − | 204 | − |
| T-120 | − | 354 | − |
| T-121 | − | 347 | − |
| T-122 | +/− | 126 | − |
| T-123 | + | 95 | − |
| T-124 | + | 84 | − |
| T-125 | + | 89 | − |
| T-126 | − | 89 | − |
| T-127 | − | 206 | − |
| T-128 | − | 343 | − |
| T-129 | +/− | 177 | − |
| T-130 | − | 118 | − |
| T-131 | +/− | 272 | − |
| T-132 | +/− | 307 | − |
| T-133 | + | 187 | − |
| T-134 | − | 60 | − |
| T-135 | + | 194 | − |
| T-136 | ++ | 99 | − |
| T-137 | + | 38 | +/− |
| T-138 | − | 86 | +/− |
| T-139 | − | 160 | +/− |
| T-140 | − | 204 | |

FIG. 27E

| RSV PEPTIDE # | Sequence | AVG. IC50 (XTT) µg/ml |
|---|---|---|
| T-12 | VVSLSNGVSVLTSKVLDLKNYIDKQLL | >500 |
| T-13 | AVVSLSNGVSVLTSKVLDLKNY | >500 |
| T-15 | VLHLEGEVNKIKSALLSTNKAVVSLSNG | >500 |
| T-19 | LLSTNKAVVSLSNGVSVLTSKVLDLKNY | >500 |
| T-28 | ASGVAVSKVLHLEGEVNKIKSALLSTNKAVVSLSNGV | >500 |
| T-29 | SGVAVSKVLHLEGEVNKIKSALLSTNKAVVSLSNG |

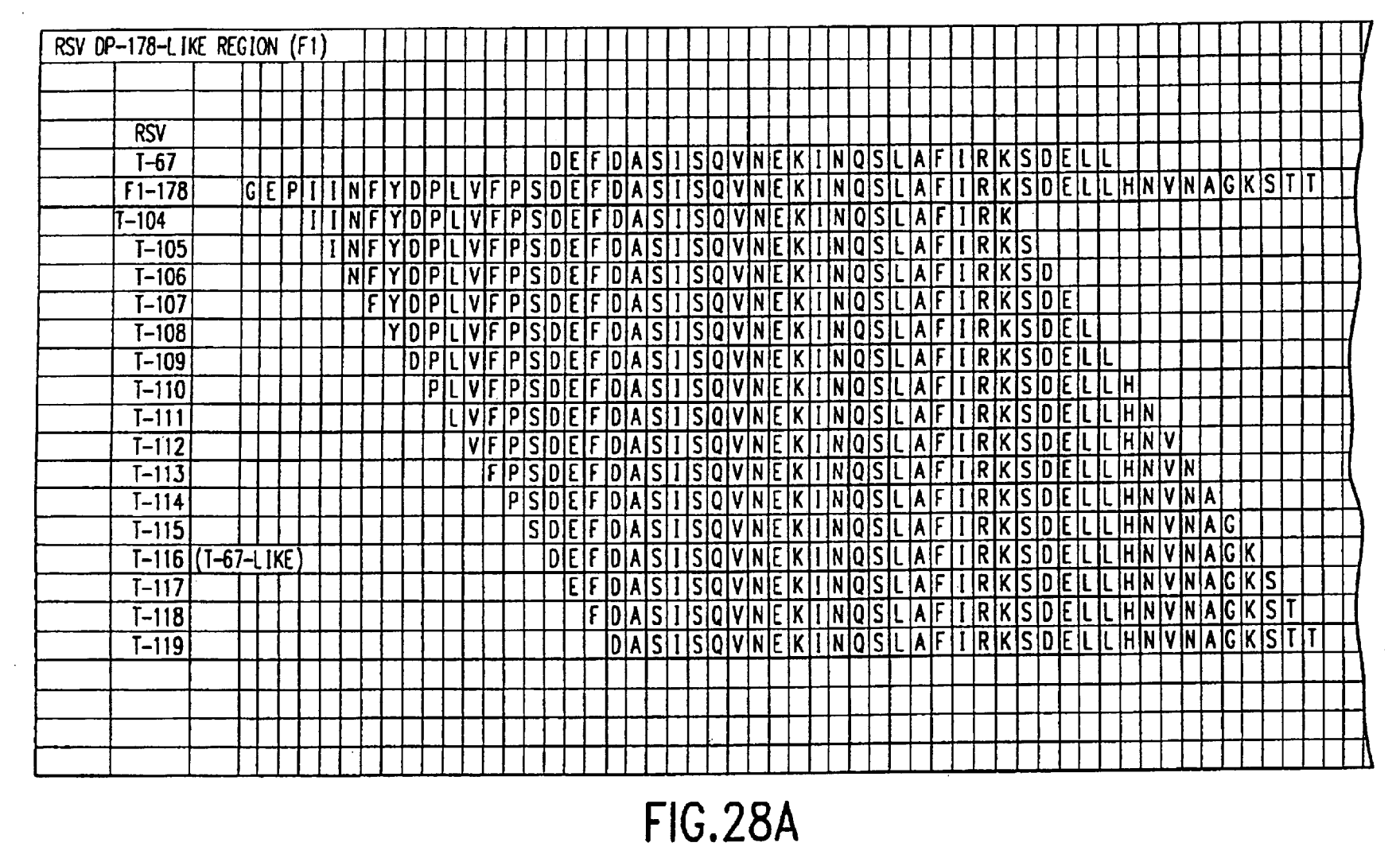

| RSV DP-178-LIKE REGION (F1) | | | | | | | | | | | | | | | | | | | |

| RSV | AV | FUSION ASSAY PURIFIED IC50 (μg/ml) (XTT) | CD |
|---|---|---|---|
| T-67 | ++ | 37 | +/- |
| F1-178 | | | |
| T-104 | + | 95 | |
| T-105 | + | 86 | |
| T-106 | - | 186 | |
| T-107 | ++ | 20 | |
| T-108 | +++ | 6 | |
| T-109 | ++ | 8 | |
| T-110 | +++ | 30 | |
| T-111 | +++ | 9 | |
| T-112 | +++ | 8 | +/- |
| T-113 | +++ | 6 | +/- |
| T-114 | +++ | 5 | +/- |
| T-115 | +++ | 6 | +/- |
| T-116 | +++ | 9 | +/- |
| T-117 | +++ | 14 | +/- |
| T-118 | +++ | 5 | +/- |
| T-119 | +++ | 6 | +/- |

FIG. 28B

| RSV PEPTIDE # | P I I N F Y D P L V F P S D E F D A S I S Q V N E K I N Q S L A F I R K S D E L L H N V | AVG. IC50 (XTT) ug/ml |
|---|---|---|
| T-71 | P I I N F Y D P L V F P S D E F D A S I S Q V N E K I N Q S L A F I R | 138 |
| T-384 | R M K Q L E D K V E E L L S K L A F I R K S D E L L H N V | NOT TESTED |
| T-613 | D E L L H N V N A G K S T | >100 |
| T-614 | K S D E L L H N V N A G K S T | >100 |
| T-615 | I R K S D E L L H N V N A G K S T | >100 |
| T-616 | A F I R K S D E L L H N V N A G K S T | >100 |
| T-617 | F D A S I S Q V N E K I N Q S L A F I | NOT TESTED |
| T-662 | S L A F I R K S D E L L H N V N A G K S T | >100 |
| T-663 | F D A S I S Q V N E K I N Q S L A F I R K S D E L L H N V N A G K | NOT TESTED |
| T-665 | F D A S I S Q V N E K I N Q S L A F I R K S D E L L H N V N A | 7 |
| T-666 | F D A S I S Q V N E K I N Q S L A F I R K S D E L L H N V | 4 |
| T-667 | F D A S I S Q V N E K I N Q S L A F I R K S D E L L H N | 4 |
| T-668 | F D A S I S Q V N E K I N Q S L A F I R K S D E L L H | 5 |
| T-669 | F D A S I S Q V N E K I N Q S L A F I R K S D E L L | 80 |
| T-670 | F D A S I S Q V N E K I N Q S L A F I R K S D | >100 |
| T-671 | A S I S Q V N E K I N Q S L A F I R K S D E L L H N V N A G K S T | 8 |
| T-672 | I S Q V N E K I N Q S L A F I R K S D E L L H N V N A G K S T | 6 |
| T-673 | Q V N E K I N Q S L A F I R K S D E L L H N V N A G K S T | 14 |
| T-674 | N E K I N Q S L A F I R K S D E L L H N V N A G K S T | >100 |
| T-675 | K I N Q S L A F I R K S D E L L H N V N A G K S T | >100 |
| T-676 | N Q S L A F I R K S D E L L H N V N A G K S T | >100 |
| T-730 | F D A S I S Q V N E K I N Q S L A F I R K S D E L L H N V N A G K S I T | NOT TESTED |

FIG. 28C

FIG. 29A

| HPIV3

| HPIV3 107 | AV | IC50 (UG/ML) | CD |
|---|---|---|---|
| 157 | − | 574* | + |
| 158 | − | 146* | + |
| 159 | − | 707* | + |
| 160 | − | 536* | + |
| 161 | − | 390* | + |
| 162 | − | 403* | + |
| 163 | − | 123* | + |
| 164 | − | 512.067* | +++ |
| 165 | − | 742* | − |
| 166 | − | 540* | − |
| 167 | − | 215* | − |
| 168 | − | 680* | − |
| 169 | − | 137* | − |
| 170 | − | 456* | − |
| 171 | − | 437* | − |
| 172 | + | 63* | − |
| 173 | ++ | 30* | − |
| 174 | + | 56* | ++ |
| T-40 | +/− | | +++ |
| 175 | +/− | 110* | ++ |
| 176 | − | 197.75* | +++ |
| 177 | − | 350* | + |
| 178 | ++ | 30* | + |
| 179 | − | 295* | − |
| 180 | − | 732* | − |
| 181 | − | 929* | − |
| 182 | − | 707* | − |
| 183 | − | 218.50* | ++ |
| 184 | + | 67.8* | +++ |
| 185 | − | 542* | − |
| 186 | − | 613* | − |
| 187 | − | 152* | − |
| 188 | − | 669* | − |

FIG. 29C

HPIV-3 DP107-LIKE WALKS

| | | | | | | | | | | | | | | | | | | | | | | | | | | | |
|---|---|---|---|---|---|---|---|---|---|---|---|---|---|---|---|---|---|---|---|---|---|---|---|---|---|---|---|
| T-42 | A | T | S | A | Q | I | I | T | A | A | V | A | L | V | E | A | K | Q | A | R | S | D | I | E | K | L | K | E | A |
| T-43 | | | | | | | A | A | V | A | L | V | E | A | K | Q | A | R | S | D | L | E | K | L | K | E | A |
| T-39 | | | | | | | | A | A | V | A | L | V | E | A | K | Q | A | R | S | D | I | E | K | L | K | E | A | I | R | D | T | N | K | A |
| T-38 | | | | | | | | | | | | | | | | | | A | K | Q | A | R | S | D | I | E | K | L | K | E | A | I | R | D | T | N | K | A | V | Q | S | V | Q | S | S |
| T-40 | | | | | | | | | | | | | | | | | | A | K | Q | A | R | S | D | I | E | K | L | K | E | A | I | R | D | T | N | K | A | V | Q | S | V | Q | S | S | I | G | N | L | I | V | A |
| T-44 | | | | | | | | | | | | | | | | | | | | | | | I | E | K | L | K | E | A | I | R | D | T | N | K | A | V | Q | S | V | Q | S | S | I | G | N | L | I | V | A |
| T-45 | | | | | | | | | | | | | | | | | | | | | | | | | | | | | | I | R | D | T | N | K | A | V | Q | S | V | Q | S | S | I | G | N | L | I | V | A | I | K | S |
| T-46 | | | | | | | | | | | | | | | | | | | | | | | | | | | | | | | | | | | | A | V | Q | S | V | Q | S | S | I | G | N | L | I | V | A | I | K | S |

| T-582 TRUNCATED 184 | L | K | E | A | I | R | D | T | N | K | A | V | Q | S | V | Q | S | S | I | G | N | L | I | V | A | I | K | S |

FIG.29D

FIG.30A

| HPIV3 178 | AV | IC50 (μg/ml) | CD |
|---|---|---|---|
| 189 | − | 827* | − |
| 190 | − | 775* | − |
| 191 | − | 612* | − |
| 192 | − | 699* | − |
| 193 | − | 525* | − |
| 194 | + | 61* | − |
| 195 | + | 49 | ± |
| 196 | +++ | 3.1 | + |
| 197 | ++++ | 71.15 | ± |
| 198 | ++++ | 0.325 | + |
| 199 | +++ | 2.3* | + |
| 200 | ++++ | 1.0* | ± |
| 201 | ++++ | 0.224* | + |
| 202 | ++++ | | + |
| 203 | ++++ | 0.390* | + |
| 204 | ++++ | 0.213 | + |
| 205 | +++ | 0.174 | + |
| 206 | ++ | 2.0* | + |
| 207 | ++ | 2.0* | + |
| 208 | ++ | 37* | + |
| 209 | +++ | 1.0* | + |
| 210 | +++ | 2.0* | + |

FIG.30B

| | | | | | | | | | | | | | | | | | | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| T-269 TRUNCATED 201 | | | | | | | | | | | | | | | | | | | | | | | | | | | E | W | I | R | R | S | N | Q | K | L | D | S | I | I | | | | | | | 457.500UG/ML |
| T-626 205 MUTANT | | | | | | | | | | | I | D | I | S | I | E | L | N | K | A | K | S | D | L | E | E | S | K | E | W | I | K | K | S | N | Q | K | L | D | S | I | I | G | N | W | H | 209.589NG/ML |
| T-383 | R | M | K | Q | L | E | D | K | V | E | E | E | L | L | S | K | L | E | W | I | R | R | S | N | Q | K | L | D | S | I | | | | | | | | | | | | | | | | | NOT DONE |
| T-577 | D | Q | Q | I | K | Q | Y | K | R | L | L | D | R | L | I | I | P | L | Y | D | G | L | R | Q | K | D | V | I | V | S | N | Q | E | S | N | | | | | | | | | | | | 133.793UG/ML* |
| T-578 | Y | S | E | L | T | N | I | F | G | D | N | I | G | S | L | Q | E | K | G | I | K | L | Q | G | I | A | S | L | Y | R | T | N | I | T | E | I | | | | | | | | | | | 107.177UG/ML* |
| T-579 | T | S | I | I | T | L | Q | V | R | L | P | L | L | T | R | L | L | N | T | Q | I | I | Y | R | V | D | S | I | I | S | Y | N | I | I | Q | N | R | E | W | Y | | | | | | | NOT DONE |

FIG.30C

FUSION         ♥ALLMOTI5♥
PEPTIDE         ♣107x178x4♣
.....RNKRGVFVLGFLGFLATAGSAMGAAS ♣♥ XXXXAQSRTLLAGIVQQQQQ

LLDVVKRQQELLRLTVWGTKNLQTRVTAIEKYLKDQAQL♣NAWG♥ CAF

♥ALLMOTI5♥
*LVS PREDICTED COILED-COIL
RQVCHTTVPWPNASLTPDW *NND ♥TWQEWERKVDFLEENITALLEEAQIQQ

♠107x178x4♠
EKNMY ♠ELQKLNSWD* VF♥ GNXXXXXXXXXXXXXXXXXXXXXXXXXXX♠

IYIVMLAKLRQGYRPVFSSPPSYFQXTHTQQDPALPTREGKEGDGGEGGGNSSWP

WQIEYIHF

FIG. 31

MTRRRVLSVVVLLAALACRLGAQTPEQPAPPATTVQPTATRQQTSFPFRVCELSSHGDLFRFSSD

♠ 107x178x4♠
IQCPSFGTRENHTEGLLMVFKDNIIPYSF ♣ KVRSYTKIVTNILIYNGWYADSVTNRHE♣

EKFSVDSY ETDQMDTIYQ CYNAVKMTKD GLTRVYVDRD GVNITVNLKP TGGLANGVRR

YASQTELYDA PGWLIWTYRT RTTVNCLITD MMAKSNSPFD FFVTTTGQTV EMSPFYDGKN

KETFHERADS FHVRTNYKIV DYDNRGTNPQ GERRAFLDKG TYTLSWKLEN RTAYCPLQHW

QTFDSTIATE TGKSIHFVTD EGTSSFVTNT TVGIELPDAF KCIEEQVNKT HEKYEAVQD

RYTKGQEAIT YFITSGGLLL AWLPLTPRSL ATVKNLTELT TPTSSPPSSP SPPAPSAARG

STPAAVLRRR RRDAGNATTP VPPTAPGKSL GTLNNPATVQ IQFAYDSLRR QINRMLGDLA

RAWCLEQKRQ NMVLRELTKI NPTTVMSSIY GKAVAAKRLG DVISVSQCVP VNQATVTLRK

SMRVPGSETM CYSRPLVSFS FINDTKTYEG QLGTDNEIFL TKKMTEVCQA TSQYYFQSGN

♠107x178x4♠
EIHVYNDYHH FKTIELDGIA TLQTFISLNT ♣SLIENIDFASLELYSRDEQRASNVFD *LE♣

*LVS PREDICTED COILED COIL*      TM Potential
GIFREYNFQAQNIAGLRKDLDNAVSN* GRNQ FVDGLGELMDSLGSVG QSITN ♣P12LZIPC♣
TM Potential     TM Potential
LVSTVGGLFSSLVSGFISF FK N ♣PFGGMLILVLVAGVVILVISL♣ TRRTRQMS

QQPVQMLYPG IDELAQQHAS GEGPGINPIS KTELQAIMLA LHEQNQEQKR AAQRAAGPSV

ASRALQAARDRFPGLRRRRY HDPETAAALL GEAETEF

FIG. 32

MMDPNSTSED VKFTPDPYQV PFVQAFDQAT RVYQDLGGPS QAPLPCVLWP VLPEPLPQGQ

LTAYHVSTAP TGSWFSAPQP APENAYQAYA APQLFPVSDI TQNQQTNQAG GEAPQPGDNS

TVQTAAAVVF ACPGANQGQQ LADIGVPQPA PVAAPARRTR KPQQPESLEE CDSELEI

@DNA BINDING@      ♣107x178X4♣    +DIMERIZATION+
@KRY KNRVASRKCRAK  ♣FK@ Q         +LLQHYREVAAAKSSENDRLRLLLKQ♣

MCPSLDVD+ SI IPRTPDVLHE DLLNF

FIG. 33

FUSION
PEPTIDE ♥ALLMOTI5♥ *LVS COILED-COIL*
FAG ♥VVLAGAALGVATAAQITAGIALHQSML*NSQAIDNLRASLETTN

QAIEAIRQAGQEMI*LAVQGVQDYINN♥ ELIPSMNQLSCDLIGQKLGLKLLRYYT

♣P23LZIPC♣
♣P6,12LZIPC♣
♠107X178X4♠
♥ALLMOTI5♥
EILSLFGPSLRD ♣PISA ♠♥EISIQLSYALGGDINKV♣ LEKLGYSGGDL♣

♣P1,12LZIPC♣
LGILES♠ RGIKARI♥ THVDTESYFIVLSIAY ♣PTLSEIKGVIVHRLEGV♣ SY

NIGSQEWYTTVPKYVATQGYLISNFDESSCTFMPEGTVCSQNALYPMSPLLQECL

RGSTKSCARTLVSGSFGNRFILSQGNLIANCASILCKCYTTGTIINQDPDKILTYIAA

♣P23LZIPC♣
♣P12LZIPC♣
♥ALLMOTI5♥
*LVS COILED-COIL*
DHCPVVEVNGVTIQVGSRRYPDAVYLHRIDLGP ♣P ♥IS *LERLDVGTNLGN

♦TRANSMEMBRANE REGION♦
AIAKLEDAKELL♣ ESSDQI*L♣ RSMK ♦GLSSTSIVYILI♥ AVCLGGLIGIP

ALICCC♦ RGRCNKKGEQVGMSRPGLKPDLTGTSKSYVRSL

FIG. 34

Pre S1 and Pre S2
MGQNLSTSNPLGFFPDHQLDPAFRANTANPDWDFNPNKDTWPDANKVGAGAFG

LGFTPPHGGLLGWSPQAQGILQTLPANPPPASTNRQSGRQPTPLSPPLRNTHPQAM

QWNSTTFHQTLQDPRVRGLYFPAGGSSSGTVNPVLTTASPLSSIFSRIGDPALN

MAJOR SURFACE ANTIGEN(HBs)
   FUSION
   PEPTIDE
    ♣P12 & 23LZIPC♣
MENITSG FLG ♣PLL VLQAGFFLLTRILTI♣ PQSLDSWWTSLNFLGGTTVCLG

♣P12 & 23LZIPC♣
QNSQSPTSNHSPTSCPPTC ♣PGYRWMCLRRFIIFLFILLLCLIFLLVLLDYQGML♣

PVCPLIPGSSTTSTGPCRTCMTTAQGTSMYPSCCCTKPSDGNCTCIPIPSSWAFGKF

♦<u>TRANSMEMBRANE REGION</u>♦
LWEWASARFSWLS ♦<u>LLVPFVQWFVGLSPTVWLSVI</u>♦ WMMWYWGPSL

♦<u>TRANSMEMBRANE REGION</u>♦

♦<u>YSILSPFLPLLPIFFCLWVYI</u>♦

FIG. 35

FUSION ♥ ALLMOTI5 ♥   ♠107x 178x4♠
PEPTIDE                *LVS COILED COIL
AIQLIPLFVG LGI ♥TTAVSTGAAGLGVS ♠IT *QYTKLSHQLISDV

QAISSTIQDLQDQVDSLAEVVLQ* NRRGLDLLTAE♠ QGGI♥

CLALQEKCCFYANKSGIVRDKIKNLQDDLERRRRQLIDNPFWTSFHG

FLPYVMPLLGPLLCLLLVLSFGPIIFNKLMTFIKHQIESIQAKPIQVHYH
                                TRANSMEMBRANE REGION
RLEQEDSGGSYLTLT......???????????????????????....

FIG. 36

MKAQKGFTLI ELMIVVAIIG ILAAIAPGQ

♣107x178x4♣
♥ALLMOTI5♥
♣♥YQDYTARTQVTRAVSEVSALKTAAESAILEGKEIVSSA♣ T♥

PK DTQYDIGFT

♣107x178x4♣
♥ALLMOTI5♥
♣♥ESTLLDGSGKSQIQVTDNQDGTVELVATLGKSSGS♣ AIKGAVITSR♥

KNDGV WNCKITKTPT AWKPNYAPAN CPKS

FIG. 37

MNTLQKGFTL IELMIVIAIV GILAAVALPA YQDYTARAQV

SEAILLAEGQ KSAVTEYYLN HGIWP

♣107x178x4♣
♥ALLMOTI5♥
♣♥KDNTSAGVASSSSIKGKYVKEVKYENGVVTAT♣

MNSSNVNKEIQGKKLSLWAKRQDGSVKW♥

FCGQP VTRNAKDDTV TADATGNDGK IDTKHLPSTC RDNFDAS

FIG. 38

MKKTLLGSLI LLAFAGNVQA DINTETSGKV TFFGKVVENT

CKVKTEHKNL SVVLNDVGKN SLSTKVNTAM PTPFTITLQN

CDPTTANGTA NKANKVGLYF Y

♣<u>107x178x4</u>♣
♥<u>ALLMOTI5</u>♥
♣♥<u>SWKNVDKENNFTLKNEQTTADYATNVNI</u>♣

QLMESNGTKAISVVGKETE♥

DF MHTNNNGVAL NQTHPNNAHI SGSTQLTTGT NELPLHFIAQ

YYATNKATAG KVQSSVDFQI AYE

FIG. 39

MNKKLLMNFF IVSPLLLATT ATDFTPVP

♣107x178x4♣
♥ALLMOTI5♥
♣♥LSSNQIIKTAKASTNDNIKDLLDWYSSGSDTFTNS♣♥

EVLDNSL GSMRIKNTDG SISLIIFPSP YYSPAFTKGE KV

♣107x178x4♣
♣DLNTKRTKKSQHTSEGTYIHFQISGVT♣

N TEKLPTPIEL PLKVKVHGKD SPLKYG

♣P12LZIPC♣
♣PKFDKKQLAISTLDFEIRHQLTQI♣

HGLYRSSDKT GGYWKITMND GSTYQSDLSK KFEYNTEKPP

INIDEIKTIE AEIN

FIG. 40

♥ALLMOTI5♥

MKKTAFILLL FIALTLTTSP L  ♥VNG

♣107x178x4♣
*LVS PREDICTED COILED-COIL*
*S ♣EKSEEINEKDLRKKSELQRNALSNLRQIY* YYNEKAITENKESDD♣

QFLENTLL♥ FKG FFTGHPW

♣107x178x4♣
♣YNDLLVDLGSKDATNKYKGKKVDLYGAY♣

YGYQCAGGTPNKTACMYGGVTLHDN NRLTEEKKVP INLWIDGKQTTV

♣P12LZIPC♣
♣PIDKVKTSKKEVTVQELDL♣ QARHYLHGK FGLYNSDSFGGKVQ

♣P12LZIPC♣
RGLIVF HSSEGSTVSY DLFDAQGQY ♣P DTLLRIYRDN KTINSENLHI♣

DLYLYTT

FIG. 41

♥ALLMOTI5♥
MKKTAFTLLL FIALTLTTSP L ♥VNGS

♣107x178x4♣
♣EKSEEINEKDLRKKSELQGTALGNLKQIYYYNEKAKTENKESHD♣ Q♥

FLQHTILFKG FFTDHSWYND LLVDFDSKDI VDKYKGKKVDLYGAYY

GYQC AGGTPNKTAC MYGGVTLHDN NRLTEEKKVPINL WLDGKQNTV

♣107x178x4♣
♥ALLMOTI5♥
♣P12LZIPC♣
♣P ♥L ♣ETVKTNKKNVTVQELDLQARRYL♣ QEKYNLYN♣

SDVFDGKVQR♥ GLIVF HTSTE

♣P23LZIPC♣
♣PSVNYDLFGAQGQYSNTLLRIYRDNKTINSENMHI♣ DIYLYTS

FIG. 42

MKNITFIFFILLASPLYANGDRLYRADSRPPDEIKRFRSLMPRGNEYFDRGT

♥ALLMOTI5♥
♥QMNINLYDHARGTQTGFVRYDDGYV

♣<u>107x178x4</u>♣
♣<u>STSLSLRSAHLAGQYILSGYSLTIYIVI</u>♣ ANMFNVNDVISVY♥

SP HPYEQEVSAL GGIPYSQIYG WYRVNFGVID ERLHRNREYR

DRYYRNLNIA PAEDGYRLAG FPPDHQAWRE EPWIHHAPQG

CGDSSRTITG DTCNE

♥ALLMOTI5♥
♥ETQNLSTIYLREYQSKVKRQIFSDYQSEVDIYNRIRDEL♥

FIG. 43

MMFSGFNADY EASSSRCSSA SPAGDSLSYY HSPADSFSSM

GSPVNAQDFC TDLAVSSANF IPTVTAISTS PDLQWLVQPA

LVSSVAPSQT RAPHPFGVPA PSAGAYSRAG VVKTMTGGRA

*LVS PREDICTED COILED-COIL*
QSIGRRGKVE QLSPEEEEKR RIRRE *RNKMA AAK

♣107x178x4♣
♥ALLMOTI5♥
♥CRNRRREL ♣TDTLQAETDQLEDEKSALQTEIANLLKEKEKL♥

EFILAAHR* PACKIPDDL GFPEEMSVAS LDLTGGLPEV

ATPESEEAFT LPLLNDPEPK PSVEPVKSIS SMELKTEPFD

DFLFPASSRP SGSETARSVP DMDLSGSFYA LPLLNDPEPK

PSVEPVKSIS SMELKTEPFD DFLFPASSRP SGSETARSVP

DMDLSGSFYA GSSSNEPSSD SLSSPTLLAL

FIG. 44

SGWESYYKTEGDEEAEEEQEENLEASGDYKYSGRDSLIFLVDASKA

MFESQSEDELTPFDMSIQCIQSVYISKIISSDRDLLAVVFYGTEKDKNS

VNFKNIYVLQELDNPGAKRILELDQFKGQQGQKRFQDMMGHGSDY

SLSEVLWVCANLFSDVQFKMSHKRIMLFTNEDNPHGNDSAKASRAR

TKAGDLRDTGIFLDLMHLKKPGGFDISLFYRDIISIAEDED

♣107x178x4♣
♥ALLMOTI5♥
*LVS PREDICTED COILED-COIL*

♥LRVH *FEE ♣SSKLEDLLRKVRAKETRKRALSRLKLKLNKDIV* ISV

GIYNLVQKAL♥ KPPPIKLYRETN♣ EPVKTKTRTFNTSTGGLLLPSDTKR

SQIYGSRQIILEKEETEELKRFDDPGLMLMGFKPLVLLKKHHLRPSLFVYPE
ESLVIGS STLFSALLIKCLEKEVAALCRYTPRRNIPPYFVALVPQEEELDDQK
IQVTPPGFQLVFLPFADDKRKMPFTEKIMATPEQVGKMKAIVEKLRFTYRS
DSFENPVLQQHFRNLEALALDLME

♣PI2LZIPC♣
♣PEQAVDLTLPKVEAMNKRL♣ GSLVDEFKELVYPPDYNPEGKVTKR
KHDNEGSGSKRPKVEYSEEELKTHISKGTLGKFTVPMLKEACRAYGLKSG
LKKQELLEALTKHFQD

FIG. 45

GGGALSPQHSAVTQGSIIKNKEGMDAKS

♠107x178x4♠
♥ALLMOTI5♥
♥♠LTAWSRTLVTFKDVFVDFTREEWKLLDT♠ AQQIVYRNV
MLENYKNLVSLGYQLT♥ KPDVILRLEKGEEPWLVEREIHQETHPD
SETAFEIKSSVSSRSIFKDKQSCDIKMEGMARNDLWYLSLEEVWKCR
DQLDKYQENPERHLRHQLIHTGEKPYECKECGKSFSRSSHLIGHQKT
HTGEEPYECKECGKSFSWFSHLVTHQRTHTGDKLYTCNQCGKSFVH
SSRLIRHQRTHTGHKPYECPECGKSFRQSTHLILHQRTHVRVRPYECN
ECGKSYSQRSHLVVHHRIHTGLKPFECKDCGKCFSRSSHLYSHQRTH
TGEKPYECHDCGKSFSQSSALIVHQRIHTGEKPYECCQCGKAFIRKN
DLIKHQRIHVGAETYKCNQCGIIFSQNS

♣P23LZIPC♣
♣PFIVHQIAHTGEQFLTCGNQCGTALVNTSNLIGQTNHI♣ RENAY

FIG. 46

| RESIDUE - 438 | P | D | A | V | Y | L | H | R | I | D | L | G | P | P | I | S | L | E | R | L | D | V | G | T | N | L | G | N | A | I | A | K | L | E | A | K | E | L | L | E | S | S | D | Q | I | L | R | S | M | -488 # |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| | | | | | | | | | | | | MEASLES ED. 178-LIKE WALK | | | | | | | | | | | | | | | | | | | | | | | | | | | | | | | | | | | | | | |
| T-252A0 | P | D | A | V | Y | L | H | R | I | D | L | G | P | P | I | S | L | E | R | L | D | V | G | T | N | L | G | N | A | I | A | K | L | E | | | | | | | | | | | | | | | | |
| T-253A0 | | D | A | V | Y | L | H | R | I | D | L | G | P | P | I | S | L | E | R | L | D | V | G | T | N | L | G | N | A | I | A | K | L | E | D | | | | | | | | | | |

| AVERAGE IC50 | CD |
|---|---|
| - | - |
| - | - |
| - | - |
| - | - |
| 1.35ug/ml | - |
| .343ug/ml | - |
| 1.78ug/ml | - |
| .186ug/ml | - |
| + | - |
| .193ug/ml | - |
| 1.32ug/ml | - |
| 1.01ug/ml | - |
| .072ug/ml | - |
| - | - |
| +/- | - |
| + | - |

FIG. 47B

| SIMIAN IMMUNODEFICIENCY VIRUS MM251 | | |
|---|---|---|
| DP178-LIKE | | |
| RESIDUE | 245 | TWQEWERKVDFLEENITALLEEAQIQQEKNMYELQKLNSWDVFGNWF |
| T-390 | 245 | TWQEWERKVDFLEENITALLEEAQIQQEKNMYELQ |
| T-391 | 246 | WQEWERKVDFLEENITALLEEAQIQQEKNMYELQK |
| T-392 | 247 | QEWERKVDFLEENITALLEEAQIQQEKNMYELQKL |
| T-393 | 248 | EWERKVDFLEENITALLEEAQIQQEKNMYELQKLN |
| T-394 | 249 | WERKVDFLEENITALLEEAQIQQEKNMYELQKLNS |
| T-395 | 250 | ERKVDFLEENITALLEEAQIQQEKNMYELQKLNSW |
| T-396 | 251 | RKVDFLEENITALLEEAQIQQEKNMYELQKLNSWD |
| T-397 | 252 | KVDFLEENITALLEEAQIQQEKNMYELQKLNSWDV |
| T-398 | 253 | VDFLEENITALLEEAQIQQEKNMYELQKLNSWDVF |
| T-399 | 254 | DFLEENITALLEEAQIQQEKNMYELQKLNSWDVFG |
| T-400 | 255 | FLEENITALLEEAQIQQEKNMYELQKLNSWDVFGN |

FIG.48A

| | RESIDUE | 47 | | | | | | ANTIVIRAL ACTIVITY SIV |
|---|---|---|---|---|---|---|---|---|
| 291 | | | | | | | | NT |
| 280 | | 35 | | | | | T390 | |
| 281 | | 35 | | | | | T391 | +++ |
| 282 | | 35 | | | | | T392 | +++ |
| 283 | | 35 | | | | | T393 | +++ |
| 284 | | 35 | | | | | T394 | +++ |
| 285 | | 35 | | | | | T395 | +++ |
| 286 | | 35 | | | | | T396 | +++ |
| 287 | | 35 | | | | | T397 | +++ |
| 288 | | 35 | | | | | T398 | +++ |
| 289 | | 35 | | | | | T399 | +++ |
| 290 | | 35 | | | | | T400 | +++ |

FIG. 48B

| HIV-1 BRU WALKS N-TERMINAL TO DP178 | | AA# | | | | | 6 6 6 6 6 6 6 6 6 6 6 6 6 6 6 6 6 6 6 6 6 6 6 6 6 6 6 6 6 6 6 6 6 6 6 6 6 6 6 6 6 6 6 6 |
|---|---|---|---|---|---|---|---|
| | | 6 | | | | | 2 2 2 2 2 2 2 2 2 2 3 3 3 3 3 3 3 3 3 3 4 4 4 4 4 4 4 4 4 4 5 5 5 5 5 5 5 5 5 5 6 6 6 6 |
| | | 1 | | \\ | | | 1 2 3 4 5 6 7 8 9 0 1 2 3 4 5 6 7 8 9 0 1 2 3 4 5 6 7 8 9 0 1 2 3 4 5 6 7 8 9 0 1 2 3 4 |
| | | 5 | | | | | N K S L E Q I W N N M T W M E W D R E I N N Y T S L I H S L I E E S L I E E S |
| | 36-MER WALK | Pt. MUTANTS ADDED | | | | | |
| T661 | X | | | | | | N K S L E Q I W N N M T W M E W D R E I N N Y T S L I H S L I E E S |
| T660 | X | | | | | | K S L E Q I W N N M T W M E W D R E I N N Y T S L I H S L I E E S |
| T659 | X | | | | | | S L E Q I W N N M T W M E W D R E I N N Y T S L I H S L I E E S |
| T658 | X | | | | | | L E Q I W N N M T W M E W D R E I N N Y T S L I H S L I E E S |
| T657 | X | | | | | | E Q I W N N M T W M E W D R E I N N Y T S L I H S L I E E S |
| T656 | X | | | | | | Q I W N N M T W M E W D R E I N N Y T S L I H S L I E E S |
| T655 | X | | | | | | I W N N M T W M E W D R E I N N Y T S L I H S L I E E S |
| T654 | X | | | | | | W N N M T W M E W D R E I N N Y T S L I H S L I E E S |
| T653 | X | | | | | | N N M T W M E W D R E I N N Y T S L I H S L I E E S |
| T652 | X | | | | | | N M T W M E W D R E I N N Y T S L I H S L I E E S |
| T651 | X | | | | | | M T W M E W D R E I N N Y T S L I H S L I E E S |
| T625 | 47-MER | | | | | | T W M E W D R E I N N Y T S L I H S L I E E S |
| T650 | X | | | | | | W M E W D R E I N N Y T S L I H S L I E E S |
| T649 | X | | | | | | M E W D R E I N N Y T S L I G S L I H S L I E E S |
| T624 | 35-MER | | | | | | E W D R E I N N Y T S L I H S L I E E S |
| T50 | X | | | | | | W D R E I N N Y T S L I H S L I E E S |
| T648 | X | | | | | | D R E I N N Y T S L I H S L I E E S |
| T647 | X | | | | | | R E I N N Y T S L I H S L I E E S |
| T711 | 30-MER | | | | | | E I N N Y T S L I H S L I E E S |
| T621 | 30-MER | | GGC | | | | |
| T646 | X | | | | | | |
| T645 | X | | | | | | |
| T644 | X | | | | | | |
| T643 | X | | | | | | |
| T642 | X | | | | | | |

FIG. 49A

| 6 | 6 | 6 | 6 | 6 | 6 | 6 | 6 | 6 | 6 | 6 | 6 | 6 | 6 | 6 | 6 | 6 | 6 | 6 | 6 | 6 | 6 | 6 | 6 | | HIV-1/IIIB IC50 ng/ml | HIV-2 NIHZ IC50 ng/ml |
|---|---|---|---|---|---|---|---|---|---|---|---|---|---|---|---|---|---|---|---|---|---|---|---|---|---|---|
| 5 | 5 | 5 | 5 | 5 | 6 | 6 | 6 | 6 | 6 | 6 | 6 | 6 | 6 | 6 | 7 | 7 | 7 | 7 | 7 | 7 | 7 | 7 | 7 | | | |
| 6 | 7 | 8 | 9 | 0 | 1 | 2 | 3 | 4 | 5 | 6 | 7 | 8 | 9 | 0 | 1 | 2 | 3 | 4 | 5 | 6 | 7 | 8 | F | | | |
| Q | N | Q | Q | E | K | N | E | Q | E | L | L | E | L | D | K | W | A | S | L | W | N | W | F | | | |
| | | | | | | | | | | | | | | | | | | | | | | | | T661 | 297* | |
| | | | | | | | | | | | | | | | | | | | | | | | | T660 | 258* | |
| | | | | | | | | | | | | | | | | | | | | | | | | T659 | 2290* | |
| | | | | | | | | | | | | | | | | | | | | | | | | T658 | 191* | |
| | | | | | | E | | | | | | | | | | | | | | | | | | T657 | 128* | |
| | | | | | | | | | | | | | | | | | | | | | | | | T656 | 5* | |
| | | | | | K | | | | | | | | | | | | | | | | | | | T655 | 2300* | |
| Q | N | Q | Q | E | K | N | E | Q | E | L | L | E | L | D | K | W | A | S | L | W | N | W | | T654 | 1* | |
| | | | | | | | | | | | | | | | | | | | | | | | | T653 | 63* | |
| | | | | | | | | | | | | | | | | | | | | | | | | T652 | 4* | |
| | | | | | | | | | | | | | | D | K | | | | | | | | | T651 | 338* | |
| | | | | | | | | | | | | | L | | | | | | | | | | | T625 | ND | |
| | | | | | | | | | | | | | | D | K | | | | | | | | | T650 | 44* | |
| | | | | | | | | | | | | | | D | K | W | | | | | | | | T649 | 8* | |
| | | | | | | | | | | | | | | | | | | | | | | | | T624 | 2 | |
| | | | | | | | | | | | G | G | C | | | | | | | | | | | T50 | 6 | |
| | | | | | | | | E | | L | L | E | L | D | K | | | | | | | | | T648 | 36 | |
| | | | | | | | | | | | | | | D | K | W | A | | | | | | | T647 | 44 | |
| | | | | | | | | | | | | | | | | | | | | | | | | T711 | ND | |
| | | | | | | | | | | | | | | | | | | | | | | | | T621 | 229 | |
| | | | | | | | | | | | | | | D | K | W | A | S | | | | | | T646 | 83 | |
| | | | | | | | | | | | | | | D | K | W | A | S | | | | | T645 | 85 | |
| | | | | | | | | | | | | | | D | K | W | A | S | L | | | | | T644 | 4960* | |
| | | | | | | | | | | | | | | D | K | W | A | S | L | | | | | T643 | 1690* | |
| | | | | | | | | E | | L | L | E | L | D | K | W | A | S | L | W | | | | T642 | 1450* | |

HIV-1 BRU 178 CONSTRUCTS, MUTATIONS, TRUNCATIONS

| Construct | TRUNC. PT. T20 Removed | TRUNC. PT. T20 Added | AA# mutants | AA positions (approx. 635, 643–678) |
|---|---|---|---|---|
| | | | 15 W / 33 W | 643 644 645 646 647 648 649 650 651 652 653 654 655 656 657 658 659 660 661 662 663 664 665 666 667 668 669 670 671 672 673 674 675 676 677 678 |
| T4 | X | | NO AC- | Y T S L I H S L I E E S Q N Q Q E K N E Q E L L E L D K W A S L W N W F |
| T228 | X | | | |
| T700 | | | | |
| T715 | X | | | Y T S L I H S L I E E S Q N Q Q E K N E Q E L L E L D K W A S L W N W F |
| T65/T716 | X | | | Y T S L I H S L I E E S Q N Q Q E K N E Q E L L E L D K W A S L W N W F |
| T714 | X | | | T S L I H S L I E E S Q N Q Q E K N E Q E L L E L D K W A S L W N W F |
| T712 | X | | | L I H S L I E E S Q N Q Q E K N E Q E L L E L D K W A S L W N W F |
| T64 | X | | | L I H S L I E E S Q N Q Q E K N E Q E L L E L D K W A S L W N W F |
| T63 | X | | | L I E E S Q N Q Q E K N E Q E L L E L D K W A S L W N W F |
| T62 | X | | | E E S Q N Q Q E K N E Q E L L E L D K W A S L W N W F |
| T3 | | X | | E S Q N Q Q E K N E Q E L L E L D K W A S L W N W F |
| T61/T102 | X | | NO AC- | N E Q E L L E L D K W A S L W N W F |
| T217 | X | | | E Q E L L E L D K W A S L W N W F |
| T218 | X | | | Q E L L E L D K W A S L W N W F (NO NH2) |
| T219 | X | | | E L L E L D K W A S L W N W F |

FIG. 49E

| | HIV-1/IIIB IC50(ng/ml) |
|---|---|
| T4 | >400000 |
| T228 | >50000 |
| T700 | >100000 |
| T715 | ND |
| T65/T716 | ND |
| T714 | ND |
| T712 | ND |
| T64 | ND |
| T63 | ND |
| T62 | ND |
| T3 | 3000 |
| T61/T102 | 64000 |
| T217 | 40000 |
| T218 | 25000 |
| T219 | 48000 |

FIG. 49F

| | | | | | | | | |
|---|---|---|---|---|---|---|---|---|
| T220 | X | | | | | | L L E L D K W A S L W N W F |
| T221 | X | | | | | | L E L D K W A S L W N W F |
| T234 | X | X | | | | E A A A R E A A R L E L D K W A S L W N W F |
| T235 | X | X | | | | R M K Q L E E A A A R L E L D K W A S L W N W F |
| T570 | X | X | | | | F W N W L S A W K D L E E L L S K L E L D K W A S L W N W F |
| T381 | X | X | | | | K V E E L L S K N Y H L E N E L L E E V K D E L Q K M R |
| T382 | X | X | | | | F W N W L S A W K D L E E L L S K N Y H L E N E L E L D K W A S L W N W F |
| T677 | X | X | | | | K V E E L L S K N Y H L E N E L L E L D K W A S L W N W F |
| T376 | X | X | | | | F W N W L S A W K D L E L Y P G S L E L D K W A S L W N W F |
| T589 | X | X | | | | CYCLIZED— C L E L D K W A S L W N W F C |
| T377 | X | X | | | | C L E L D K W A S L A N W F C |
| T590 | X | X | | | | CYCLIZED— C L E L D K W A S L A N W F C |
| T378 | X | X | | | | C L E L D K W A S L W N F F C |
| T591 | X | X | | | | CYCLIZED— C L E L D K W A S L W N F F C |
| T270 | X | X | | | | L E L D K W A S L W N W F |
| T271 | X | X | | | | L E L D K W A S L A N A F |
| T272 | X | X | | | | L E L D K W A S L F N F F |
| T273 | X | X | | | | L E L D K W A S L A N W F |
| T608 | X | X | | | | L E L D K W A A S L W N W A |
| T609 | X | X | | | | L E L D K W A A S L W N W F |
| T610 | X | X | | | | L E L D K W A A S L W N W F |
| T611 | X | X | | | | L K L D K W A A S A W N W F |
| T612 | X | X | | | | L E L D K W A A S L W N W F |
| T222 | X | X | | | | L E L D K W A S L W N W F |
| T223 | X | X | | | | L D K W A S L W N W F |
| T60/T224 | X | | | | | L D K W A S L W N W F |
| T225 | X | | | | | D K W A S L W N W F |
| T226 | X | | | | | K W A S L W N W F |
| T227 | X | | | | | A S L W N W F |

FIG. 49G

| | |
|---|---|
| T220 | 59000 |
| T221 | 16000 |
| T234 | >100000 |
| T235 | 53000 |
| T570 | >100000 |
| T381 | 89000 |
| T382 | 190000 |
| T677 | 6310 |
| T376 | >100000 |
| T589 | 745000 |
| T377 | 69000 |
| T590 | 30290 |
| T378 | 95000 |
| T591 | 59000 |
| T270 | >200000 |
| T271 | 16000 |
| T272 | 1000 |
| T273 | >100000 |
| T608 | >100000 |
| T609 | >100000 |
| T610 | >100000 |
| T611 | 70000 |
| T612 | >100000 |
| T222 | 49000 |
| T223 | 57000 |
| T60/T224 | 77000 |
| T225 | >100000 |
| T226 | >100000 |
| T227 | >100000 |

FIG. 49H

FIG. 49I

| | | | | | | 6 6 6 6 6 6 6 6 6 6 6 6 6 6 6 6 | 5 5 5 5 6 6 6 6 6 6 6 7 7 7 7 7 | 5 6 7 8 9 0 1 2 3 4 5 6 7 8 9 0 | Q N Q Q E K N E Q E L L E L D K W A S L W N W F | | 7 | 1 | 7 | | | | |
|---|---|---|---|---|---|---|---|---|---|---|---|---|---|---|
| | | | | | | 6 6 6 6 6 6 6 6 6 6 6 6 6 6 6 6 | 7 7 7 7 7 7 7 7 7 7 7 | 1 2 3 4 5 6 7 8 | N W N W F | | | | | HIV-1/IIIB IC50 (ng/ml) |
| | | | | | | Q | N | Q | Q | E | K | N | E | Q | L | L | L | E | L | D | K | W | A | S | L | W | N | W | F | T595 | 112 |
| | | | | | | Q | N | Q | Q | E | K | N | E | Q | L | L | L | E | L | D | K | W | A | S | L | W | N | W | F | T574 | ND |
| | | | | | | Q | N | Q | Q | E | K | N | E | Q | L | L | L | E | L | D | K | W |

FIG. 49K

| | | | | | | | | | | | | | |
|---|---|---|---|---|---|---|---|---|---|---|---|---|---|
| T99 | X | | | | | | Y | T | S | L | I | H | S | L | I | E | E | S |
| T103 | X | | | | | | Y | T | S | L | I | H | S | L | I | E | E | S |
| T212 | X | | | | | | Y | T | S | L | I | H | S | L | I | E | E | S |
| T213 | X | | | | | | Y | T | S | L | I | H | S | L | I | E | E | S |
| T214 | X | | | | | | Y | T | S | L | I | H | S | L | I | E | Q | S |
| T215 | X | | | | | | Y | T | S | L | I | Q | S | L | I | E | E | S |
| T216 | X | | | | | | Y | T | S | L | I | H | S | L | I | E | E | S |
| T229 | X | | | | | | Y | T | S | L | I | Q | S | L | I | Q | E | S |
| T230 | X | | | | | | Y | T | S | L | I | H | S | L | I | E | E | S |
| T231 | X | | | | | | Y | T | S | L | I | H | S | L | I | E | E | S |
| T379 | X | | | | | | Y | T | S | L | I | H | S | L | I | E | E | S |
| T701 | X | | | | | | Y | T | S | L | I | H | S | L | I | E | E | S |
| T702 | X | | | | | | Y | T | S | L | I | H | S | L | I | E | E | S |
| T703 | X | | | | | | Y | T | S | L | I | H | S | L | I | E | E | S |
| T704 | X | | | | | | Y | T | S | L | I | H | S | L | I | E | E | S |
| T705 | X | | | | | | Y | T | S | L | I | H | S | L | I | E | E | S |
| T706 | X | | | | | | Y | T | S | L | I | H | S | L | I | E | E | S |
| T156 | X | | | | | | L | L | D | N | F | E | S | T | W | E | Q | S |
| T89 | X | | | | | | L | L | D | N | F | E | S | T | W | E | Q | S |
| T90 | X | | | | | | L | S | N | L | L | Q | I | S | N | N | S | D |

| Sequence | ID | Value |
|---|---|---|
| Q N Q E K N Q E L L Q L D K W A S L W N W F | T99 | 56 |
| Q N Q E K N E Q E L L E L D K W A S L W N W F | T103 | ND |
| Q N Q E K N Q E L L E L D K W A S L W N W F | T212 | 3 |
| Q N Q E K N Q E L L E L N K W A S L W N W F | T213 | 25 |
| Q N Q E K N Q E L L E L D K W A S L W N W F | T214 | 19 |
| Q N Q E K N Q E L L E L D K W A S L W N W F | T215 | 23 |
| Q N Q E K N Q E L L E L D K W A S L A N A A | T216 | 1000 |
| Q N Q E K N Q E L L E L D K W A S L W N W F | T229 | >100000 |
| Q N Q E K N Q E L L E L D K E A S L W N W F | T230 | 6 |
| Q N Q E K N Q Q E L L E L D K W A S L F N F F | T231 | 4 |
| Q N L Q E K N Q E L L E L D K W A S L W N W F | T379 | 0.3 |
| Q N Q E K N Q E L L E F D K W A S L W N W F | T701 | 3 |
| Q N Q Q E K N E Q E L L E L D K W A S L W N W F | T702 | 36 |
| Q N Q E K N Q E L L E L D K P A S L W N W F | T703 | 0.5 |
| Q N Q E K N Q E L L E L D K W A S P W N W F | T704 | 510 |
| Q N Q E K Q E Q E L L E L D K W A S L W N W F | T705 | 14 |
| Q N Q E K N Q E L L E L N L H K S A L Q E Y W N S F | T706 | 68 |
| K E L W E Q Q E I S I Q N L H K S A L Q E Y W | T156 | 80000 |
| K E L W E A L E I E H E K W K L T Q W Q S Y E Q F | T89 | >100000 |
| E W L E A L E I E H E K W K L T Q W Q S Y E Q F | T90 | >100000 |

FIG. 49L

FIG. 50A

HIV-1 BRU DP-107 PEPTIDES

Position: 515 ... 540

Reference sequence (top row): V M T L T V Q A R Q L L S Q I V Q Q N N L L R A I E A Q Q H L L Q L T V W G I K Q L

| ID | WALK | TRUNCATION | ADDITION | Sequence |
|---|---|---|---|---|
| T10 | 28-MER | | | |
| T37 | 28-MER | | UNBLOCKED | M T L T V Q A R Q L L S Q I V Q Q N N L L R A I E A Q Q |
| T48 | 28-MER | | | M T L T V Q A R Q L L S Q I V Q Q N N L L R A I E A Q |
| T36 | 28-MER | | | Q A R Q L L S Q I V Q Q N N L L R A I E A Q Q H L L Q |
| T8 | 28-MER | | UNBLOCKED | R Q L L S Q I V Q Q N N L L R A I E A Q Q H L L Q L T |
| T33 | 28-MER | | | V Q Q N N L L R A I E A Q Q H L L Q L T V W |
| T21 | 38-MER | | | V Q Q N N L L R A I E A Q Q H L L Q L T V W G I K Q L |
| T85 | | | BIOTIN | N N L L R A I E A Q Q H L L Q L T V W G I K Q L |
| T1 | | x | BIOTIN | |
| T2 | | x | UNBLOCKED | N N L L R A I E A Q Q H L L Q L T V W G I K Q L |
| T7 | | x | UNBLOCKED | L R A I E A Q Q H L L Q L T V W G I K Q L |
| T34 | | x | | L R A I E A Q Q H L L Q L T V W G I K Q L |
| T6 | 28-MER | | UNBLOCKED | G I K Q L |
| T35 | 28-MER | | | Q H L L Q L T V W G I K Q L |
| T5 | 28-MER | | | Q H L L Q L T V W G I K Q L |

| | | | | | | | | | | | | | | | | | | | | | | |
|---|---|---|---|---|---|---|---|---|---|---|---|---|---|---|---|---|---|---|---|---|---|---|
| | | | | | | | | | | | | | | | | | | | | 6 | | |
| | | | | | | | | | | | | | | | | | | | | 0 | | |
| | | | | | | | | | | | | | | | | | | | | 2 | | |
| Q | A | R | I | L | A | V | E | R | Y | L | K | D | Q | Q | L | L | G | I | W | G | | |
| | | | | | | | | | | | | | | | | | | | | | | HIV/IIIB IC50(μg/ml) |
| | | | | | | | | | | | | | | | | | | | | | T10 | 50 |
| | | | | | | | | | | | | | | | | | | | | | T37 | 75* |
| | | | | | | | | | | | | | | | | | | | | | T48 | 83* |
| | | | | | | | | | | | | | | | | | | | | | T36 | 45* |
| | | | | | | | | | | | | | | | | | | | | | T8 | 50 |
| | | | | | | | | | | | | | | | | | | | | | T33 | >100* |
| Q | A | R | I | L | A | V | E | R | Y | L | K | D | Q | | | | | | | | T21 | 2 |
| Q | A | R | I | L | A | V | E | R | Y | L | K | D | Q | | | | | | | | T86 | 2 |
| Q | A | R | I | L | A | V | E | R | Y | L | K | D | Q | | | | | | | | T1 | >100 |
| | | | | | | | | | | | | | | | | | | | | | T2 | ND |
| Q | A | R | I | L | A | V | | | | | | | | | | | | | | | T7 | 26 |
| A | R | I | L | A | V | | | | | | | | | | | | | | | | T34 | >100* |
| Q | A | R | I | L | A | V | E | R | Y | L | K | D | Q | | | | | | | | T6 | 44 |
| Q | A | R | I | L | A | V | E | R | Y | L | K | D | Q | | | | | | | | T35 | >100* |
| Q | A | R | I | L | A | V | E | R | Y | L | K | D | Q | Q | L | L | G | I | W | G | T3 | 55 |

FIG.50B

| RESIDUE | EPSTEIN-BARR VIRUS STRAIN B95.8 BZLF1 TRANSACTIVATOR PROTEIN EB1 OR ZEBRA | | | | | | | | | | | | | | | | | | | | | | | | | | | | ACT | RES |
|---|---|---|---|---|---|---|---|---|---|---|---|---|---|---|---|---|---|---|---|---|---|---|---|---|---|---|---|---|---|---|
| | 173 | S | E | L | E | I | K | R | Y | K | N | R | V | A | S | R | K | C | R | A | K | F | K | Q | L | L | Q | H | Y | R | E | V | A | A | A | K | S | S | E | N | D | R | L | R | L | L | 219 | | |
| T-423 | 173 | S | E | L | E | I | K | R | Y | K | N | R | V | A | S | R | K | C | R | A | K | F | K | Q | L | L | Q | H | Y | R | E | V | A | A | A | K | | | | | | | | | | | 208 | ++ | 35 |
| T-424 | 174 | | E | L | E | I | K | R | Y | K | N | R | V | A | S | R | K | C | R | A | K | F | K | Q | L | L | Q | H | Y | R | E | V | A | A | A | K | S | | | | | | | | | | 209 | – | 35 |
| T-425 | 175 | | | L | E | I | K | R | Y | K | N | R | V | A | S | R | K | C | R | A | K | F | K | Q | L | L | Q | H | Y | R | E | V | A | A | A | K | S | S | | | | | | | | | 210 | – | 35 |
| T-426 | 176 | | | | E | I | K | R | Y | K | N | R | V | A | S | R | K | C | R | A | K | F | K | Q | L | L | Q | H | Y | R | E | V | A | A | A | K | S | S | E | | | | | | | | 211 | – | 35 |
| T-427 | 177 | | | | | I | K | R | Y | K | N | R | V | A | S | R | K | C | R | A | K | F | K | Q | L | L | Q | H | Y | R | E | V | A | A | A | K | S | S | E | N | | | | | | | 212 | – | 35 |
| T-428 | 178 | | | | | | K | R | Y | K | N | R | V | A | S | R | K | C | R | A | K | F | K | Q | L | L | Q | H | Y | R | E | V | A | A | A | K | S | S | E | N | D | | | | | | 213 | – | 35 |
| T-429 | 179 | | | | | | | R | Y | K | N | R | V | A | S | R | K | C | R | A | K | F | K | Q | L | L | Q | H | Y | R | E | V | A | A | A | K | S | S | E | N | D | R | | | | | 214 | – | 35 |
| T-430 | 180 | | | | | | | | Y | K | N | R | V | A | S | R | K | C | R | A | K | F | K | Q | L | L | Q | H | Y | R | E | V | A | A | A | K | S | S | E | N | D | R | L | | | | 215 | – | 35 |
| T-431 | 181 | | | | | | | | | K | N | R | V | A | S | R | K | C | R | A | K | F | K | Q | L | L | Q | H | Y | R | E | V | A | A | A | K | S | S | E | N | D | R | L | R | | | 216 | – | 35 |
| T-432 | 182 | | | | | | | | | | N | R | V | A | S | R | K | C | R | A | K | F | K | Q | L | L | Q | H | Y | R | E | V | A | A | A | K | S | S | E | N | D | R | L | R | L | | 217 | – | 35 |
| T-433 | 183 | | | | | | | | | | | R | V | A | S | R | K | C | R | A | K | F | K | Q | L | L | Q | H | Y | R | E | V | A | A | A | K | S | S | E | N | D | R | L | R | L | L | 218 | – | 35 |
| T-434 | 184 | | | | | | | | | | | | V | A | S | R | K | C | R | A | K | F | K | Q | L | L | Q | H | Y | R | E | V | A | A | A | K | S | S | E | N | D | R | L | R | L | L | 219 | – | 35 |

FIG. 51A

FIG.51B

| RESIDUE | | | | | | | | | | | | | | | | | | | | | | | | | | | | | | | | | | | | | | | | | | | | | | ACT | RES |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| | 185 | A | S | R | K | C | R | A | K | F | Q | L | L | Q | H | Y | R | E | V | A | A | A | K | S | S | E | N | D | R | L | R | L | L | L | K | Q | M | C | P | S | L | D | V | D | S | 230 | 45 |
| T-435 | 185 | A | S | R | K | C | R | A | K | F | Q | L | L | Q | H | Y | R | E | V | A | A | A | K | S | S | E | N | D | R | L | R | L | L | L | K | | | | | | | | | | | 220 | – | 35 |
| T-436 | 186 | | S | R | K | C | R | A | K | F | Q | L | L | Q | H | Y | R | E | V | A | A | A | K | S | S | E | N | D | R | L | R | L | L | L | K | Q | | | | | | | | | | 221 | – | 35 |
| T-437 | 187 | | | R | K | C | R | A | K | F | Q | L | L | Q | H | Y | R | E | V | A | A | A | K | S | S | E | N | D | R | L | R | L | L | L | K | Q | | | | | | | | | | 222 | – | 35 |
| T-438 | 188 | | | | K | C | R | A | K | F | Q | L | L | Q | H | Y | R | E | V | A | A | A | K | S | S | E | N | D | R | L | R | L | L | L | K | Q | M | | | | | | | | | 223 | – | 35 |
| T-439 | 189 | | | | | C | R | A | K | F | Q | L | L | Q | H | Y | R | E | V | A | A | A | K | S | S | E | N | D | R | L | R | L | L | L | K | Q | M | C | P | | | | | | | 224 | ++ | 35 |
| T-440 | 190 | | | | | | R | A | K | F | Q | L | L | Q | H | Y | R | E | V | A | A | A | K | S | S | E | N | D | R | L | R | L | L | L | K | Q | M | C | P | S | | | | | | 225 | – | 35 |
| T-441 | 191 | | | | | | | A | K | F | Q | L | L | Q | H | Y | R | E | V | A | A | A | K | S | S | E | N | D | R | L | R | L | L | L | K | Q | M | C | P | S | L | | | | | 226 | + | 35 |
| T-442 | 192 | | | | | | | | K | F | Q | L | L | Q | H | Y | R | E | V | A | A | A | K | S | S | E | N | D | R | L | R | L | L | L | K | Q | M | C | P | S | L | D | V | | | 227 | – | 35 |
| T-443 | 193 | | | | | | | | | F | Q | L | L | Q | H | Y | R | E | V | A | A | A | K | S | S | E | N | D | R | L | R | L | L | L | K | Q | M | C | P | S | L | D | | | | 228 | – | 35 |
| T-444 | 194 | | | | | | | | | | Q | L | L | Q | H | Y | R | E | V | A | A | A | K | S | S | E | N | D | R | L | R | L | L | L | K | Q | M | C | P | S | L | D | V | D | | 229 | + | 35 |
| T-445 | 195 | | | | | | | | | | | L | L | Q | H | Y | R | E | V | A | A | A | K | S | S | E | N | D | R | L | R | L | L | L | K | Q | M | C | P | S | L | D | V | D | S | 230 | + | 35 |
| T-446 | 196 | | | | | | | | | | | | L | Q | H | Y | R | E | V | A | A | A | K | S | S | E | N | D | R | L | R | L | L | L | K | Q | M | C | P | S | L | D | V | D | S | 231 | – | 35 |

FIG.51C

| RESIDUE | | | | | | | | | | | | | | | | | | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| T-447 | 197 | L | Q | H | Y | R | E | V | A | A | K | S | S | E | N | D | R | L | R | L | L | L | K | Q | M | C | P | S | L | D | V | D | S | I | I | P | R | T | P | D | V | L | H | E | D | 242 | 45 |
| T-448 | 197 | L | Q | H | Y | R | E | V | A | A | K | S | S | E | N | D | R | L | R | L | L | L | K | Q | M | C | P | S | L | D | V | D | S | I | I | P | | | | | | | | | | 232 | 35 |
| T-449 | 198 | | Q | H | Y | R | E | V | A | A | K | S | S | E | N | D | R | L | R | L | L | L | K | Q | M | C | P | S | L | D | V | D | S | I | I | P | R | | | | | | | | | 233 | 35 |
| T-450 (#) | 199 | | | H | Y | R | E | V | A | A | K | S | S | E | N | D | R | L | R | L | L | L | K | Q | M | C | P | S | L | D | V | D | S | I | I | P | R | T | | | | | | | | 234 | 35 |
| T-451 | 200 | | | | Y | R | E | V | A | A | K | S | S | E | N | D | R | L | R | L | L | L | K | Q | M | C | P | S | L | D | V | D | S | I | I | P | R | T | P | | | | | | | 235 | 35 |
| T-452 | 201 | | | | | R | E | V | A | A | K | S | S | E | N | D | R | L | R | L | L | L | K | Q | M | C | P | S | L | D | V | D | S | I | I | P | R | T | P | D | | | | | | 236 | 35 |
| T-453 | 202 | | | | | | E | V | A | A | K | S | S | E | N | D | R | L | R | L | L | L | K | Q | M | C | P | S | L | D | V | D | S | I | I | P | R | T | P | D | V | | | | | 237 | 35 |
| T-454 | 203 | | | | | | | V | A | A | K | S | S | E | N | D | R | L | R | L | L | L | K | Q | M | C | P | S | L | D | V | D | S | I | I | P | R | T | P | D | V | L | | | | 238 | 35 |
| T-455 | 204 | | | | | | | | A | A | K | S | S | E | N | D | R | L | R | L | L | L | K | Q | M | C | P | S | L | D | V | D | S | I | I | P | R | T | P | D | V | L | H | | | 239 | 35 |
| T-456 | 205 | | | | | | | | | A | K | S | S | E | N | D | R | L | R | L | L | L | K | Q | M | C | P | S | L | D | V | D | S | I | I | P | R | T | P | D | V | L | H | E | | 240 | 35 |
| T-457 | 206 | | | | | | | | | | K | S | S | E | N | D | R | L | R | L | L | L | K | Q | M | C | P | S | L | D | V | D | S | I | I | P | R | T | P | D | V | L | H | E | D | 241 | 35 |
| T-458 | 207 | | | | | | | | | | | S | S | E | N | D | R | L | R | L | L | L | K | Q | M | C | P | S | L | D | V | D | S | I | I | P | R | T | P | D | V | L | H | E | D | L | 242 | 35 |
| | 208 | | | | | | | | | | | | | | | | | | | | | | | | | | | | | | | | | | | | | | | | | | | | | 243 | |

| RESIDUE | | | | | | | | | | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|---|---|---|---|---|---|---|---|---|
| T-459 | 209 | S | E | N | D | R | L | R | L | L | L | K | Q | M | C | P | S | L | D | V | D | S | I | I | P | R | T | P | D | V | L | H | E | D | L | L | N | F | 246 | 37 |
| T-460 | 209 | S | E | N | D | R | L | R | L | L | L | K | Q | M | C | P | S | L | D | V | D | S | I | I | P | R | T | P | D | V | L | H | E | D | L | L | N | | 244 | 35 |
| T-461 | 210 | | E | N | D | R | L | R | L | L | L | K | Q | M | C | P | S | L | D | V | D | S | I | I | P | R | T | P | D | V | L | H | E | D | L | L | N | | 245 | 35 |
| | 211 | | | N | D | R | L | R | L | L | L | K | Q | M | C | P | S | L | D | V | D | S | I | I | P | R | T | P | D | V | L | H | E | D | L | L | N | F | 246 | 35 |

DOMAIN I:
174 P-L-L-V-L-Q-A-G-F-F-L-L-T-R-I-L-T-I-P-Q-S-L-D-S-W-W-T-S-L-N-F-L-G-G-T-T-V-C-L-G-Q-N-S-Q-S-P 219

P-L-L-V-L-Q-A-G-F-F-L-L-T-R-I-L-T-I-P-Q-S-L-D-S-W-W-T-S-L-N-F-L-G-G-T-T
L-L-V-L-Q-A-G-F-F-L-L-T-R-I-L-T-I-P-Q-S-L-D-S-W-W-T-S-L-N-F-L-G-G-T-T-I
L-V-L-Q-A-G-F-F-L-L-T-R-I-L-T-I-P-Q-S-L-D-S-W-W-T-S-L-N-F-L-G-G-T-T-I-V
V-L-Q-A-G-F-F-L-L-T-R-I-L-T-I-P-Q-S-L-D-S-W-W-T-S-L-N-F-L-G-G-T-T-V-C
L-Q-A-G-F-F-L-L-T-R-I-L-T-I-P-Q-S-L-D-S-W-W-T-S-L-N-F-L-G-G-T-T-V-C-L
Q-A-G-F-F-L-L-T-R-I-L-T-I-P-Q-S-L-D-S-W-W-T-S-L-N-F-L-G-G-T-T-V-C-L-G
A-G-F-F-L-L-T-R-I-L-T-I-P-Q-S-L-D-S-W-W-T-S-L-N-F-L-G-G-T-T-V-C-L-G-Q
G-F-F-L-L-T-R-I-L-T-I-P-Q-S-L-D-S-W-W-T-S-L-N-F-L-G-G-T-T-V-C-L-G-Q-N
F-F-L-L-T-R-I-L-T-I-P-Q-S-L-D-S-W-W-T-S-L-N-F-L-G-G-T-T-V-C-L-G-Q-N-S
F-L-L-T-R-I-L-T-I-P-Q-S-L-D-S-W-W-T-S-L-N-F-L-G-G-T-T-V-C-L-G-Q-N-S-Q
L-L-T-R-I-L-T-I-P-Q-S-L-D-S-W-W-T-S-L-N-F-L-G-G-T-T-V-C-L-G-Q-N-S-Q-S

FIG.52A

```
DOMAIN II:
233 P-G-Y-R-W-M-C-L-R-R-F-I-I-F-L-F-I-L-L-L-C-L-I-F-L-L-V-L-L-D-Y-Q-G-M-L-P-V-C-P-L-I-P-G-S-S-T-T-S-T-G-P-C-R-T-C-M-T-T 290

P-G-Y-R-W-M-C-L-R-R-F-I-I-F-L-F-I-L-L-L-C-L-I-F-L-L-V-L-L-D-Y-Q-G-M-L
      G-Y-R-W-M-C-L-R-R-F-I-I-F-L-F-I-L-L-L-C-L-I-F-L-L-V-L-L-D-Y-Q-G-M-L-P
        Y-R-W-M-C-L-R-R-F-I-I-F-L-F-I-L-L-L-C-L-I-F-L-L-V-L-L-D-Y-Q-G-M-L-P-V
          R-W-M-C-L-R-R-F-I-I-F-L-F-I-L-L-L-C-L-I-F-L-L-V-L-L-D-Y-Q-G-M-L-P-V-C
            W-M-C-L-R-R-F-I-I-F-L-F-I-L-L-L-C-L-I-F-L-L-V-L-L-D-Y-Q-G-M-L-P-V-C-P
              M-C-L-R-R-F-I-I-F-L-F-I-L-L-L-C-L-I-F-L-L-V-L-L-D-Y-Q-G-M-L-P-V-C-P-L
                C-L-R-R-F-I-I-F-L-F-I-L-L-L-C-L-I-F-L-L-V-L-L-D-Y-Q-G-M-L-P-V-C-P-L-I
                  L-R-R-F-I-I-F-L-F-I-L-L-L-C-L-I-F-L-L-V-L-L-D-Y-Q-G-M-L-P-V-C-P-L-I-P
                    R-R-F-I-I-F-L-F-I-L-L-L-C-L-I-F-L-L-V-L-L-D-Y-Q-G-M-L-P-V-C-P-L-I-P-G
                      R-F-I-I-F-L-F-I-L-L-L-C-L-I-F-L-L-V-L-L-D-Y-Q-G-M-L-P-V-C-P-L-I-P-G-S
                        F-I-I-F-L-F-I-L-L-L-C-L-I-F-L-L-V-L-L-D-Y-Q-G-M-L-P-V-C-P-L-I-P-G-S-S
                          I-I-F-L-F-I-L-L-L-C-L-I-F-L-L-V-L-L-D-Y-Q-G-M-L-P-V-C-P-L-I-P-G-S-S-T-T

I-F-L-F-I-L-L-L-C-L-I-F-L-L-V-L-L-D-Y-Q-G-M-L-P-V-C-P-L-I-P-G-S-S-T-T-S
                              F-L-F-I-L-L-L-C-L-I-F-L-L-V-L-L-D-Y-Q-G-M-L-P-V-C-P-L-I-P-G-S-S-T-T-S-T
                                L-F-I-L-L-L-C-L-I-F-L-L-V-L-L-D-Y-Q-G-M-L-P-V-C-P-L-I-P-G-S-S-T-T-S-T-G
                                  F-I-L-L-L-C-L-I-F-L-L-V-L-L-D-Y-Q-G-M-L-P-V-C-P-L-I-P-G-S-S-T-T-S-T-G-P
                                    I-L-L-L-C-L-I-F-L-L-V-L-L-D-Y-Q-G-M-L-P-V-C-P-L-I-P-G-S-S-T-T-S-T-G-P-C
                                      L-L-L-C-L-I-F-L-L-V-L-L-D-Y-Q-G-M-L-P-V-C-P-L-I-P-G-S-S-T-T-S-T-G-P-C-R
                                        L-L-C-L-I-F-L-L-V-L-L-D-Y-Q-G-M-L-P-V-C-P-L-I-P-G-S-S-T-T-S-T-G-P-C-R-T
                                          L-C-L-I-F-L-L-V-L-L-D-Y-Q-G-M-L-P-V-C-P-L-I-P-G-S-S-T-T-S-T-G-P-C-R-T-C
                                            C-L-I-F-L-L-V-L-L-D-Y-Q-G-M-L-P-V-C-P-L-I-P-G-S-S-T-T-S-T-G-P-C-R-T-C-M
                                              L-I-F-L-L-V-L-L-D-Y-Q-G-M-L-P-V-C-P-L-I-P-G-S-S-T-T-S-T-G-P-C-R-T-C-M-T
                                                I-F-L-L-V-L-L-D-Y-Q-G-M-L-P-V-C-P-L-I-P-G-S-S-T-T-S-T-G-P-C-R-T-C-M-T-T
```

FIG.52B

| | | Fusion IC50 µg/ml | T888 IC50 Conc. (nM) |
|---|---|---|---|
| T112 | Ac-VFPSDEFDASISQVNEKINQSLAFIRKSDELLHNV-NH2 | 0.30 | 1 |
| T800 | Ac-AAASDEFDASISQVNEKINQSLAFIRKSDELLHNV-NH2 | 2.6 | 6.4 |
| T801 | Ac-VFPAAAFDASISQVNEKINQSLAFIRKSDELLHNV-NH2 | 1.7 | Insoluble |
| T802 | Ac-VFPSDEAAASISQVNEKINQSLAFIRKSDELLHNV-NH2 | 3 | 75.6 |
| T803 | Ac-VFPSDEFDAAAAQVNEKINQSLAFIRKSDELLHNV-NH2 | 2.1 | 7.3 |
| T804 | Ac-VFPSDEFDASISAAAEKINQSLAFIRKSDELLHNV-NH2 | 1.3 | 28.7 |
| 7805 | Ac-VFPSDEFDASISQVNAAANQSLAFIRKSDELLHNV-NH2 | 2.1 | |
| T806 | Ac-VFPSDEFDASISQVNEKIAAALAFIRKSDELLHNV-NH2 | 0.9 | 3.5 |
| T807 | Ac-VFPSDEFDASISQVNEKINQSAAAIRKSDELLHNV-NH2 | 0.5 | 195 |
| T808 | Ac-VFPSDEFDASISQVNEKINQSLAFAAASDELLHNV-NH2 | 0.5 | 7.2 |
| T809 | Ac-VFPSDEFDASISQVNEKINQSLAFIRKAAALLHNV-NH2 | 3.8 | Insoluble |
| T810 | Ac-VFPSDEFDASISQVNEKINQSLAFIRKSDEAAANV-NH2 | 1.3 | 624 |
| T811 | Ac-VFPSDEFDASISQVNEKINQSLAFIRKSDELLAAA-NH2 | 1.6 | 4.8 |
| T1669 | Ac-VFPSDEADASISQVNEKINQSLAFIRKSDELLHNV-NH2 | | |
| T1670 | Ac-VFPSDEFAASISQVNEKINQSLAFIRKSDELLHNV-NH2 | | |
| T1671 | Ac-VFPSDEFDASISAVNEKINQSLAFIRKSDELLHNV-NH2 | | |
| T1672 | AC-VFPSDEFDASISQANEKINQSLAFIRKSDELLHNV-NH2 | | |
| T1673 | Ac-VFPSDEFDASISQVNAEKINQSLAFIRKSDELLHNV-NH2 | | |
| T1680 | Ac-VFPSDEFDASISQVNEKINQSLAAIRKSDELLHNV-NH2 | | |
| T1681 | Ac-VFPSDEFDASISQVNEKINQSLAFIRKSDEALHNV-NH2 | | |
| T1682 | Ac-VFPSDEFDASISQVNEKINQSLAFIRKSDEALHNV-NH2 | | |
| T1683 | Ac-VFPSDEFDASISQVNEKINQSLAFIRKSDELAHNV-NH2 | | |
| T1684 | AC-VFPSDEFDASISQVNEKINQSLAFIRKSDELLANV-NH2 | | |

FIG. 53

| | | Does Substitution prevent CD interaction? | Fusion IC50 (ng/mL) | T83 ELARA (Biot-T20) IC50 Conc. (nM) | T1342 FP (Fluo-T20) IC50 Conc. (nM) |
|---|---|---|---|---|---|
| T20 | Ac-YTSLIHSLIEESQNQQEKNEQELLELDKWASLWNWF-NH2 | Native | 2 | 69 | |
| T813 | Ac-AAAAIHSLIEESQNQQEKNEQELLELDKWASLWNWF-NH2 | | 3 | 1000 | |
| T878 | Ac-YTSAAASLIEESQNQQEKNEQELLELDKWASLWNWF-NH2 | Reduced | 37 | 1000 | |
| T877 | Ac-YTSLIHAAAEESQNQQEKNEQELLELDKWASLWNWF-NH2 | Inhibited | 1757 | Neg | |
| T876 | Ac-YTSLIHSLIAAAQNQQEKNEQELLELDKWASLWNWF-NH2 | Native | 11 | 29 | |
| T875 | Ac-YTSLIHSLIEESAAAQEKNEQELLELDKWASLWNWF-NH2 | Inhibited | 33 | >3000 | |
| T874 | Ac-YTSLIHSLIEESQNQAAANEQELLELDKWASLWNWF-NH2 | Inhibited | 545 | >3000 | |
| T873 | Ac-YTSLIHSLIEESQNQQEKAAAELLELDKWASLWNWF-NH2 | Inhibited | 814 | Neg | |
| T872 | Ac-YTSLIHSLIEESQNQQEKNEQAAAELDKWASLWNWF-NH2 | Native | 23 | 66 | |
| T871 | Ac-YTSLIHSLIEESQNQQEKNEQELLAAAKWASLWNWF-NH2 | Inhibited | 89 | 1156 | |
| T870 | Ac-YTSLIHSLIEESQNQQEKNEQELLELDAAASLWNWF-NH2 | Reduced | 8 | 251 | |
| T869 | Ac-YTSLIHSLIEESQNQQEKNEQELLELDKWAAAANWF-NH2 | Reduced | 28 | 57 | |
| T868 | Ac-YTSLIHSLIEESQNQQEKNEQELLELDKWASLWAAA-NH2 | Reduced | 56 | 56 | |
| | | | | | |
| T1663 | Ac-ATSLIHSLIEESQNQQEKNEQELLELDKWASLWNWF-NH2 | Native | | | |
| T1664 | Ac-YASLIHSLIEESQNQQEKNEQELLELDKWASLWNWF-NH2 | Native | | | |
| T1665 | Ac-YTALIHSLIEESQNQQEKNEQELLELDKWASLWNWF-NH2 | Native | | | |
| T1660 | Ac-YTSAIHSLIEESQNQQEKNEQELLELDKWASLWNWF-NH2 | Reduced | | | |
| T1661 | Ac-YTSLAHSLIEESQNQQEKNEQELLELDKWASLWNWF-NH2 | Reduced | | | |
| T1662 | Ac-YTSLIASLIEESQNQQEKNEQELLELDKWASLWNWF-NH2 | Native | | | |

FIG. 54A

| | | | | |
|---|---|---|---|---|
| T1656 | Ac-YTSLIHALIEESQNQQEKNEQELLELDKWASLWNWF-NH2 | Native | | |
| T1657 | Ac-YTSLIHSAIEESQNQQEKNEQELLELDKWASLWNWF-NH2 | Reduced | | |
| T1659 | Ac-YTSLIHSLAEESQNQQEKNEQELLELDKWASLWNWF-NH2 | Inhibited | | |
| T1653 | Ac-YTSLIHSLIEESANQQEKNEQELLELDKWASLWNWF-NH2 | Native | | 60 |
| T1654 | Ac-YTSLIHSLIEESQAQQEKNEQELLELDKWASLWNWF-NH2 | Native | | |
| T1655 | Ac-YTSLIHSLIEESQNAQEKNEQELLELDKWASLWNWF-NH2 | Inhibited | | |
| T1650 | Ac-YTSLIHSLIEESQNQAEKNEQELLELDKWASLWNWF-NH2 | Inhibited | | 1000 |
| T1651 | Ac-YTSLIHSLIEESQNQQAKNEQELLELDKWASLWNWF-NH2 | Native | | 14 |
| T1652 | Ac-YTSLIHSLIEESQNQQEANEQELLELDKWASLWNWF-NH2 | Native | | 40 |
| T1630 | Ac-YTSLIHSLIEESQNQQEKAEQELLELDKWASLWNWF-NH2 | Inhibited | | >1000 |
| T1631 | Ac-YTSLIHSLIEESQNQQEKNAQELLELDKWASLWNWF-NH2 | Reduced | | 200 |
| T1632 | Ac-YTSLIHSLIEESQNQQEKNEAELLELDKWASLWNWF-NH2 | Native | | 27 |
| T1627 | Ac-YTSLIHSLIEESQNQQEKNEQELLALDKWASLWNWF-NH2 | Native | | 27 |
| T1628 | Ac-YTSLIHSLIEESQNQQEKNEQELLEADKWASLWNWF-NH2 | Reduced | | 250 |
| T1629 | Ac-YTSLIHSLIEESQNQQEKNEQELLELAKWASLWNWF-NH2 | Native | | 53 |

FIG. 54B

METHODS AND COMPOSITIONS FOR INHIBITION OF MEMBRANE FUSION-ASSOCIATED EVENTS, INCLUDING HIV TRANSMISSION

1. INTRODUCTION

The present invention relates, first, to DP178 (SEQ ID NO:1), a peptide, also referred to herein as T20, corresponding to amino acids 638 to 673 of the HIV-$1_{LAI}$ transmembrane protein (TM) gp41, and portions or analogs of DP178 (SEQ ID NO:1), which exhibit anti-membrane fusion capability, antiviral activity, such as the ability to inhibit HIV transmission to uninfected CD-$4^+$ cells, or an ability to modulate intracellular processes involving coiled-coil peptide structures. The present invention also relates to peptides analogous to DP107 (SEQ ID NO:25), a peptide, which is also referred to herein as T21, corresponding to amino acids 558 to 595 of the HIV-$1_{LAI}$ transmembrane protein (TM) gp41, having amino acid sequences present in other viruses, such as enveloped viruses, and/or other organisms, and further relates to the uses of such peptides. These peptides exhibit anti-membrane fusion capability, antiviral activity, or the ability to modulate intracellular processes involving coiled-coil peptide structures.

The gp41 region from which DP107 is derived is referred to herein as HR1. The gp41 region from which DP178 is derived is referred to herein as HR2. As discussed herein, the gp41 HR1 and HR2 regions interact (non-covalently) with each other and/or with T20 and T21 peptides. This interaction is required for normal infectivity of HIV.

The present invention therefore additionally relates to methods for identifying compounds, including small molecule compounds, that disrupt the interaction between DP178 and DP107, and/or between DP107-like and DP178-like peptides. In one embodiment, such methods relate to identification and utilization of modified DP178, DP178-like, DP107 and DP107-like peptides and peptide pairs that interact with each other at a lower affinity than the affinity exhibited by corresponding "parent" or "native" peptides. Further, the invention relates to the use of DP178, DP178 portions, DP107, DP017 portions and/or analogs and other modulators, including small molecules modulators, of DP178/DP107, DP178-like/DP107-like, or HR1/HR2 interactions as antifusogenic or antiviral compounds or as inhibitors of intracellular events involving coiled-coil peptide structures. The invention is demonstrated, first, by way of an Example wherein DP178 (SEQ ID:1), and a peptide whose sequence is homologous to DP178 are each shown to be potent, non-cytotoxic inhibitors of HIV-1 transfer to uninfected CD-$4^+$ cells. The invention is further demonstrated by Examples wherein peptides having structural and/or amino acid motif similarity to DP107 and DP178 are identified in a variety of viral and nonviral organisms, and in examples wherein a number of such identified peptides derived from several different viral systems are demonstrated to exhibit antiviral activity. The invention is still further demonstrated by way of Examples wherein other DP178-like and DP107-like peptides are identified that interact with their corresponding HR1 and HR2 domains with a lower affinity than the affinity exhibited by the native DP178 or DP107 peptide from which they are derived.

2. BACKGROUND OF THE INVENTION

2.1. Membrane Fusion Events

Membrane fusion is a ubiquitous cell biological process (for a review, see White, J. M., 1992, Science 258:917–924). Fusion events which mediate cellular housekeeping functions, such as endocytosis, constitutive secretion, and recycling of membrane components, occur continuously in all eukaryotic cells.

Additional fusion events occur in specialized cells. Intracellularly, for example, fusion events are involved in such processes as occur in regulated exocytosis of hormones, enzymes and neurotransmitters. Intercellularly, such fusion events feature prominently in, for example, sperm-egg fusion and myoblast fusion.

Fusion events are also associated with disease states. For example, fusion events are involved in the formation of giant cells during inflammatory reactions, the entry of all enveloped viruses into cells, and, in the case of human immunodeficiency virus (HIV), for example, are responsible for the virally induced cell-cell fusion which leads to cell death.

2.2. The Human Immunodeficiency Virus

The human immunodeficiency virus (HIV) has been implicated as the primary cause of the slowly degenerative immune system disease termed acquired immune deficiency syndrome (AIDS) (Barre-Sinuossi, F. et al., 1983, Science 220:868–870; Gallo, R. et al., 1984, Science 224:500–503). There are at least two distinct types of HIV: HIV-1 (Barre-Sinoussi, F. et al., 1983, Science 220:868–870; Gallo R. et al., 1984, Science 224:500–503) and HIV-2 (Clavel, F. et al., 1986, Science 233:343–346; Guyader, M. et al., 1987, Nature 326:662–669). Further, a large amount of genetic heterogeneity exists within populations of each of these types. Infection of human CD-$4^+$ T-lymphocytes with an HIV virus leads to depletion of the cell type and eventually to opportunistic infections, neurological dysfunctions, neoplastic growth, and ultimately death.

HIV is a member of the lentivirus family of retroviruses (Teich, N. et al., 1984, RNA Tumor Viruses, Weiss, R. et al., eds., CSH-Press, pp. 949–956). Retroviruses are small enveloped viruses that contain a diploid, single-stranded RNA genome, and replicate via a DNA intermediate produced by a virally-encoded reverse transcriptase, an RNA-dependent DNA polymerase (Varmus, H., 1988, Science 240:1427–1439). Other retroviruses include, for example, oncogenic viruses such as human T-cell leukemia viruses (HTLV-I, -II, -III), and feline leukemia virus.

The HIV viral particle consists of a viral core, composed of capsid proteins, that contains the viral RNA genome and those enzymes required for early replicative events. Myristylated Gag protein forms an outer viral shell around the viral core, which is, in turn, surrounded by a lipid membrane enveloped derived from the infected cell membrane. The HIV enveloped surface glycoproteins are synthesized as a single 160 Kd precursor protein which is cleaved by a cellular protease during viral budding into two glycoproteins, gp41 and gp120. gp41 is a transmembrane protein and gp120 is an extracellular protein which remains non-covalently associated with gp41, possibly in a trimeric or multimeric form (Hammarskjold, M. and Rekosh, D., 1989, Biochem. Biophys. Acta 989:269–280).

HIV is targeted to CD-$4^+$ cells because the CD-4 cell surface protein acts as the cellular receptor for the HIV-1 virus (Dalgleish, A. et al., 1984, Nature 312:763–767; Klatzmann et al., 1984, Nature 312:767–768; Maddon et al., 1986, Cell 47:333–348). Viral entry into cells is dependent upon gp120 binding the cellular CD-$4^+$ receptor molecules (McDougal, J. S. et al., 1986, Science 231:382–385; Maddon, P. J. et al., 1986, Cell 47:333–348) and thus explains HIV's tropism for CD-$4^{30}$ cells, while gp41 anchors the enveloped glycoprotein complex in the viral membrane.

2.3. HIV Treatment

HIV infection is pandemic and HIV associated diseases represent a major world health problem. Although considerable effort is being put into the successful design of effective therapeutics, currently no curative anti-retroviral drugs against AIDS exist. In attempts to develop such drugs, several stages of the HIV life cycle have been considered as targets for therapeutic intervention (Mitsuya, H. et al., 1991, FASEB J. 5:2369–2381). For example, virally encoded reverse transcriptase has been one focus of drug development. A number of reverse-transcriptase-targeted drugs, including 2',3'-dideoxynucleoside analogs such as AZT, ddI, ddC, and D4T have been developed which have been shown to been active against HIV (Mitsuya, H. et al., 1991, Science 249:1533–1544). While beneficial, these nucleoside analogs are not curative, probably due to the rapid appearance of drug resistant HIV mutants (Lander, B. et al., 1989, Science 243:1731–1734). In addition, the drugs often exhibit toxic side effects such as bone marrow suppression, vomiting, and liver function abnormalities.

Attempts are also being made to develop drugs which can inhibit viral entry into the cell, the earliest stage of HIV infection. Here, the focus has thus far been on CD4, the cell surface receptor for HIV. Recombinant soluble CD4, for example, has been shown to inhibit infection of CD-4+ T-cells by some HIV-1 strains (Smith, D. H. et al., 1987, Science 238:1704–1707). Certain primary HIV-1 isolates, however, are relatively less sensitive to inhibition by recombinant CD-4 (Daar, E. et al., 1990, Proc. Natl. Acad. Sci. UDA 87:6574–6579). In addition, recombinant soluble CD-4 clinical trials have produced inconclusive results (Schooley, R. et al., 1990, Ann. Int. Med. 112:247–253; Kahn, J. O. et al., 1990, Ann. Int. Med. 112:254–261; Yarchoan, R. et al., 1989, Proc. Vth Int. Conf. on AIDS, p. 564, MCP 137).

The late stages of HIV replication, which involve crucial virus-specific secondary processing of certain viral proteins, have also been suggested as possible anti-HIV drug targets. Late stage processing is dependent on the activity of a viral protease, and drugs are being developed which inhibit this protease (Erickson, J., 1990, Science 249:527–533). The clinical outcome of these candidate drugs is still in question.

Attention is also being given to the development of vaccines for the treatment of HIV infection. The HIV-1 enveloped proteins (gp160, gp120, gp41) have been shown to be the major antigens for anti-HIV antibodies present in AIDS patients (Barin, et al., 1985, Science 228:1094–1096). Thus far, therefore, these proteins seem to be the most promising candidates to act as antigens for anti-HIV vaccine development. To this end, several groups have begun to use various portions of gp160, gp120, and/or gp41 as immunogenic targets for the host immune system. See for example, Ivanoff, L. et al., U.S. Pat. No. 5,141,867; Saith, G. et al., WO 92/22,654; Shafferman, A., WO 91/0-9,872; Formoso, C. et al., WO 90/07,119. Clinical results concerning these candidate vaccines, however, still remain far in the future.

Thus, although a great deal of effort is being directed to the design and testing of anti-retroviral drugs, a truly effective, non-toxic treatment is still needed.

3. SUMMARY OF THE INVENTION

The present invention relates, first, to DP178, a 36-amino acid synthetic peptide, also referred to herein as T20, corresponding to amino acids 638 to 673 of the transmembrane protein (TM) gp41 from the HIV-1 isolate LAI (HIV-1$_{LAI}$), which exhibits potent anti-HIV-1 activity. The gp41 region from which DP178 is derived in referred to herein as HR2.

The invention further relates to those portions and analogs of DP178 which also show such antiviral activity, and/or show anti-membrane fusion capability, or an ability to modulate intracellular processes involving coiled-coil peptide structures. The term "DP178 analog" refers to a peptide which contains an amino acid sequence corresponding to the DP178 peptide sequence present within the gp41 protein of HIV-1$_{LAI}$, but found in viruses and/or organisms other than HIV-1$_{LAI}$. Such DP178 analog peptides may, therefore, correspond to DP178-like amino acid sequences present in other viruses, such as, for example, enveloped viruses, such as retroviruses other than HIV-1$_{LAI}$, as well as non-enveloped viruses. Further, such analogous DP178 peptides may also correspond to DP178-like amino acid sequences present in nonviral organisms.

The invention further relates to DP107, a peptide, which is also referred to herein as T21, corresponding to amino acids 558–595 of the HIV-1$_{LAI}$ transmembrane protein (TM) gp41. The gp41 region from which DP107 is derived is referred to herein as HR1. The invention also relates to those portions and analogs of DP107 which that also show antiviral activity, and/or show anti-membrane fusion capability, or an ability to modulate intracellular processes involving coiled-coil peptide structures. The term "DP107 analog" as used herein refers to a peptide which contains an amino acid sequence corresponding to the DP107 peptide sequence present within the gp41 protein of HIV-1$_{LAI}$, but found in viruses and organisms other than HIV-1$_{LAI}$. Such DP107 analog peptides may, therefore, correspond to DP107-like amino acid sequences present in other viruses, such as, for for example, enveloped viruses, such as retroviruses other than HIV-1$_{LAI}$, as well as non-enveloped viruses. Further, such DP107 analog peptides may also correspond to DP107-like amino acid sequences present in nonviral organisms.

Further, the peptides of the invention include DP107 analog and DP178 analog peptides having amino acid sequences recognized or identified by the 107×178×4, ALLMOTI5 and/or PLZIP search motifs described herein.

The peptides of the invention may, for example, exhibit antifusogenic activity, antiviral activity, and/or may have the ability to modulate intracellular processes which involve coiled-coil peptide structures. With respect to the antiviral activity of the peptides of the invention, such an antiviral activity includes, but is not limited to the inhibition of HIV transmission to uninfected CD-4+ cells. Additionally, the antifusogenic capability, antiviral activity or intracellular modulatory activity of the peptides of the invention merely requires the presence of the peptides of the invention, and, specifically, does not require the stimulation of a host immune response directed against such peptides.

The peptides of the invention may be used, for example, as inhibitors of membrane fusion-associated events, such as, for example, the inhibition of human and non-human retroviral, especially HIV, transmission to uninfected cells. It is further contemplated that the peptides of the invention may be used as modulators of intracellular events involving coiled-coil peptide structures.

The peptides of the invention may, alternatively, be used to identify compounds, including small molecule compounds, which may themselves exhibit antifusogenic, antiviral, or intracellular modulatory activity. For example, in one embodiment, the peptides of the invention are used to identify other DP178-like and/or DP107-like peptides that interact with each other and/or with their complementary HR1 or HR2 domains with a lower affinity than the affinity exhibited by the "parent" or "native" DP178 or DP107 peptides from which they are derived. Such DP178-like and DP107-like peptides, which are also part of the present invention, may also be used, e.g., to identify compounds, such as small molecule compounds, that exhibit antifusogenic, antiviral, or intracellular modulatory activity.

Additional uses include, for example, the use of the peptides of the invention as organism or viral type and/or subtype-specific diagnostic tools.

The terms "antifusogenic" and "anti-membrane fusion", as used herein, refer to an agent's ability to inhibit or reduce the level of membrane fusion events between two or more moieties relative to the level of membrane fusion which occurs between said moieties in the absence of the peptide. The moieties may be, for example, cell membranes or viral structures, such as viral envelopes or pili. The term "antiviral", as used herein, refers to the compound's ability to inhibit viral infection of cells, via, for example, cell-cell fusion or free virus infection. Such infection may involve membrane fusion, as occurs in the case of enveloped viruses, or some other fusion event involving a viral structure and a cellular structure (e.g., such as the fusion of a viral pilus and bacterial membrane during bacterial conjugation).

It is also contemplated that the peptides of the invention may exhibit the ability to modulate intracellular events involving coiled-coil peptide structures. "Modulate", as used herein, refers to a stimulatory or inhibitory effect on the intracellular process of interest relative to the level or activity of such a process in the absence of a peptide of the invention.

Embodiments of the invention are demonstrated below wherein an extremely low concentration of DP178 (SEQ ID:1), and very low concentrations of a DP178 homolog (SEQ ID:3) are shown to be potent inhibitors of HIV-1 mediated CD-4$^+$ cell-cell fusion (i.e., syncytial formation) and infection of CD-4$^+$ cells by cell-free virus. Further, it is shown that DP178 (SEQ ID:1) is not toxic to cells, even at concentrations 3 logs higher than the inhibitory DP-178 (SEQ ID:1) concentration.

The present invention is based, in part, on the surprising discovery that the DP107 and DP178 domains of the HIV gp41 protein non-covalently complex with each other, and that their interaction is required for the normal infectivity of the virus. This discovery is described in the Example presented, below, in Section 8. The invention, therefore, further relates to methods for identifying antifusogenic, including antiviral, compounds that disrupt the interaction between DP107 and DP178, and/or between DP107-like and DP178-like peptides.

Additional embodiments of the invention (specifically, the Examples presents in Sections 9–16 and 19–25, below) are demonstrated, below, wherein peptides, from a variety of viral and nonviral sources, having structural and/or amino acid motif similarity to DP107 and DP178 are identified, and search motifs for their identification are described. Further, Examples (in Sections 17, 18, 25–29) are presented wherein a number of the peptides of the invention are demonstrated exhibit substantial antiviral activity or activity predictive of antiviral activity.

3.1. Definitions

Peptides are defined herein as organic compounds comprising two or more amino acids covalently joined by peptide bonds. Peptides may be referred to with respect to the number of constituent amino acids, i.e., a dipeptide contains two amino acid residues, a tripeptide contains three, etc. Peptides containing ten or fewer amino acids may be referred to as oligopeptides, while those with more than ten amino acid residues are polypeptides. Such peptides may also include any of the modifications and additional amino and carboxy groups as are described herein.

Peptide sequences defined herein are represented by one-letter symbols for amino acid residues as follows:
A (alanine)
R (arginine)
N (asparagine)
D (aspartic acid)
C (systeine)
Q (glutamine)
E (glutamic acid)
G (glycine)
H (histidine)
I (isoleucine)
L (leucine)
K (lysine)
M (methionine)
F (phenylalanine)
P (proline)
S (serine)
T (threonine)
W (tryptophan)
Y (tyrosine)
V (valine)

4. BRIEF DESCRIPTION OF THE FIGURES

FIG. 1. Amino acid sequence of DP178 (SEQ ID:1) derived from HIV$_{LAI}$; DP178 homologs derived from HIV-1$_{SF2}$ (DP-185; SEQ ID:3), HIV-1$_{RF}$ (SEQ ID:4), and HIV-1$_{MN}$ (SEQ ID:5); DP178 homologs derived from amino acid sequences of two prototypic HIV-2 isolates, namely, HIV-2$_{rod}$ SEQ ID:6) and HIV-2$_{NIHZ}$ (SEQ ID:7); control peptides: DP-180 (SEQ ID:2), a peptide incorporating the amino acid residues of DP178 in a scrambled sequence; DP-118 (SEQ ID:10) unrelated to DP178, which inhibits HIV-1 cell free virus infection; DP-125 (SEQ ID:8), unrelated to DP178, also inhibits HIV-1 cell free virus infection; DP-116 (SEQ ID:9), unrelated to DP178, is negative for inhibition of HIV-1 infection when tested using a cell-free virus infection assay. Throughout the figures, the one letter amino acid code is used.

FIG. 2. Inhibition of HIV-1 cell-free virus infection by synthetic peptides. IC$_{50}$ refers to the concentration of peptide that inhibits RT production from infected cells by 50% compared to the untreated control. Control: the level of RT produced by untreated cell cultures infected with the same level of virus as treated cultures.

Figure 3:
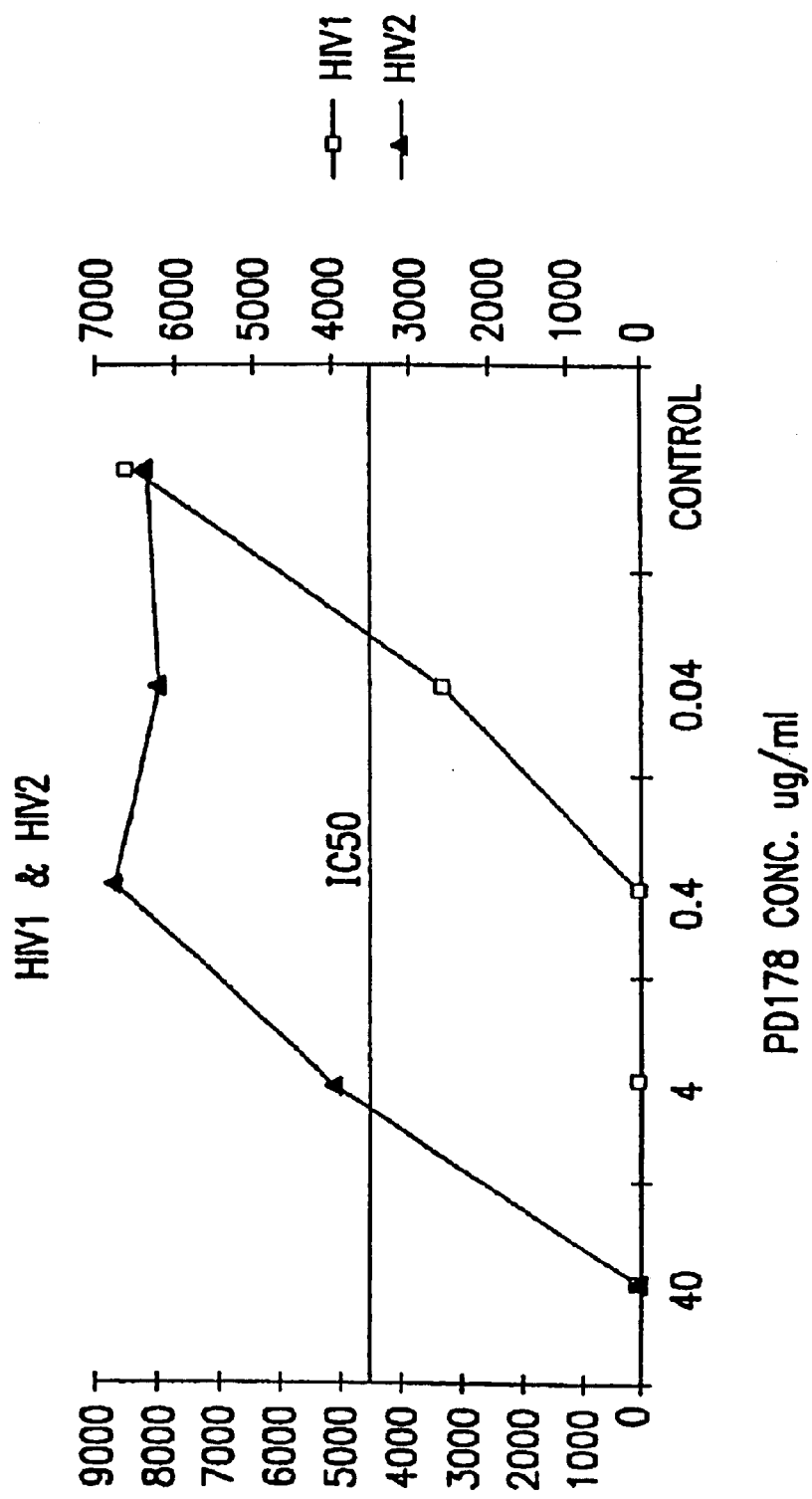

FIG. 3. Inhibition of HIV-1 and HIV-2 cell-free virus infection by the synthetic peptide DP178 (SEQ ID:1). IC$_{50}$: concentration of peptide that inhibits RT production by 50% compared to the untreated control. Control: Level of RT produced by untreated cell cultures infected with the same level of virus as treated cultures.

FIGS. 4A–4B. Fusion Inhibition Assays. FIG. 4A: DP178 (SEQ ID:1) inhibition of HIV-1 prototypic isolate-mediated syncytial formation; data represents the number of virus-induced syncytial per cell. FIG. 4B: DP-180 (SEQ ID:2) represents a scrambled control peptide; DP-185 (SEQ ID:3) represents a DP178 homolog derived from HIV-1$_{SF2}$ isolate; Control, refers to the number of syncytial produced in the absence of peptide.

FIG. 5. Fusion inhibition assay: HIV-1 vs. HIV-2. Data represents the number of virus-induced syncytial per well. ND: not done.

Figure 6:
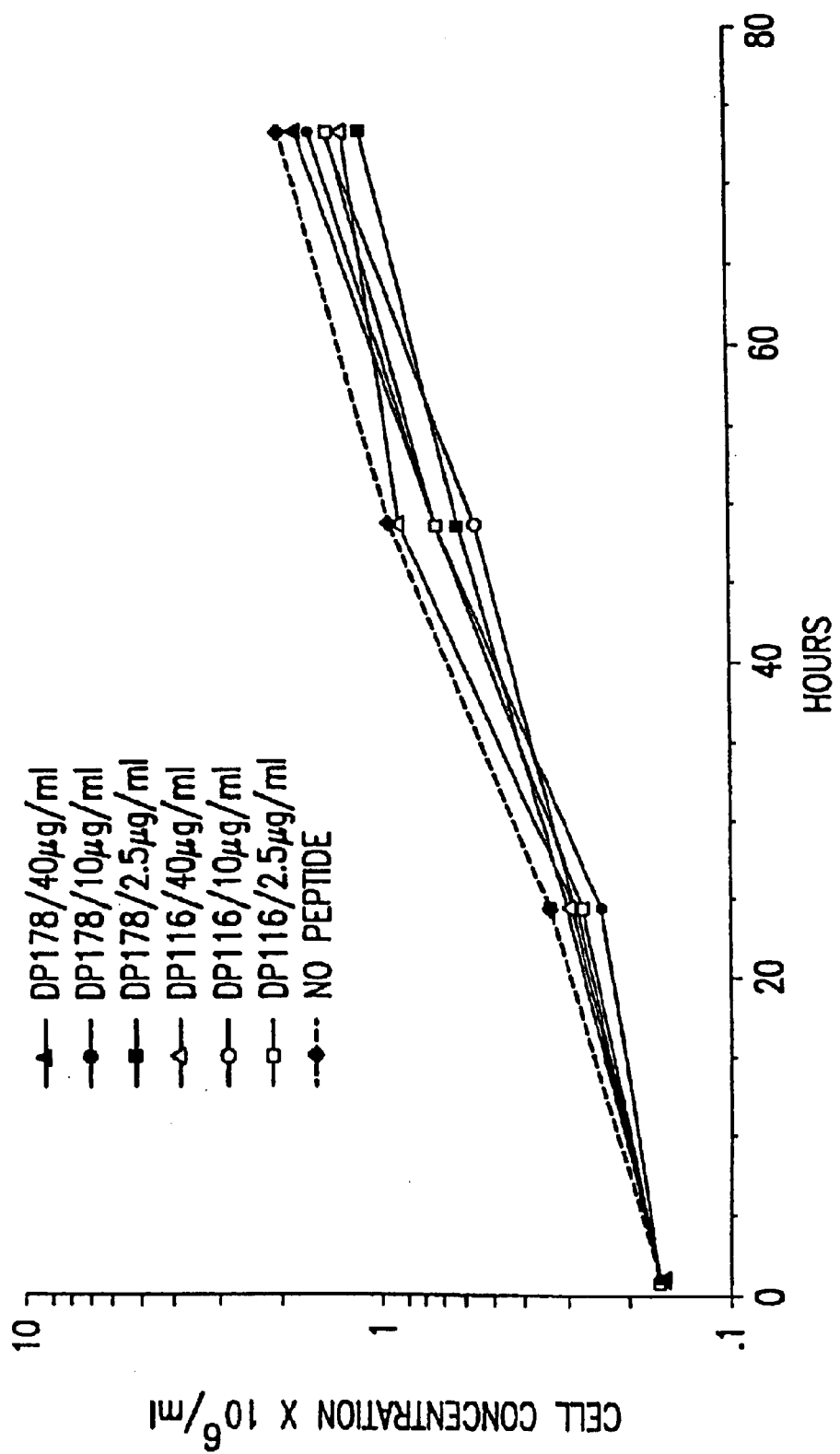

FIG. 6. Cytotoxicity study of DP178 (SEQ ID:1) and DP-116 (SEQ ID:9) on CEM cells. Cell proliferation data is shown.

Figure 7:
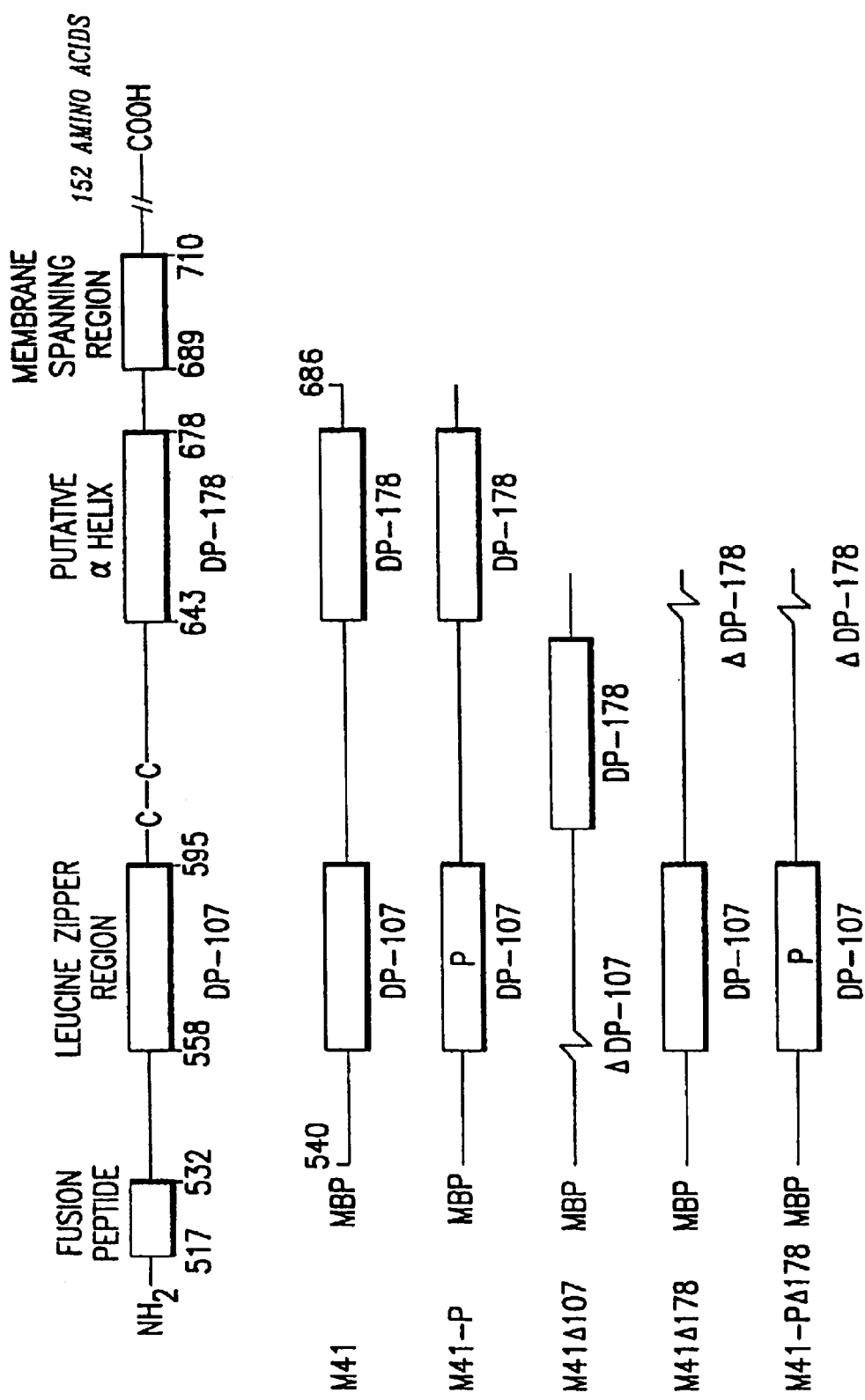

FIG. 7. Schematic representation of HIV-gp41 and maltose binding protein (MBP)-gp41 fusion proteins. DP107 and DP178 are synthetic peptides based on the two putative helices of gp41. The letter P in the DP107 boxes denotes an Ile to Pro mutation at amino acid number 578. Amino acid residues are numbered according to Meyers et al., "Human Retroviruses and AIDS", 1991, Theoret. Biol. and Biopbys. Group, Los Alamos Natl. Lab., Los Alamos, N.Mex. The proteins are more fully described, below, in Section 8.1.1.

Figure 8:
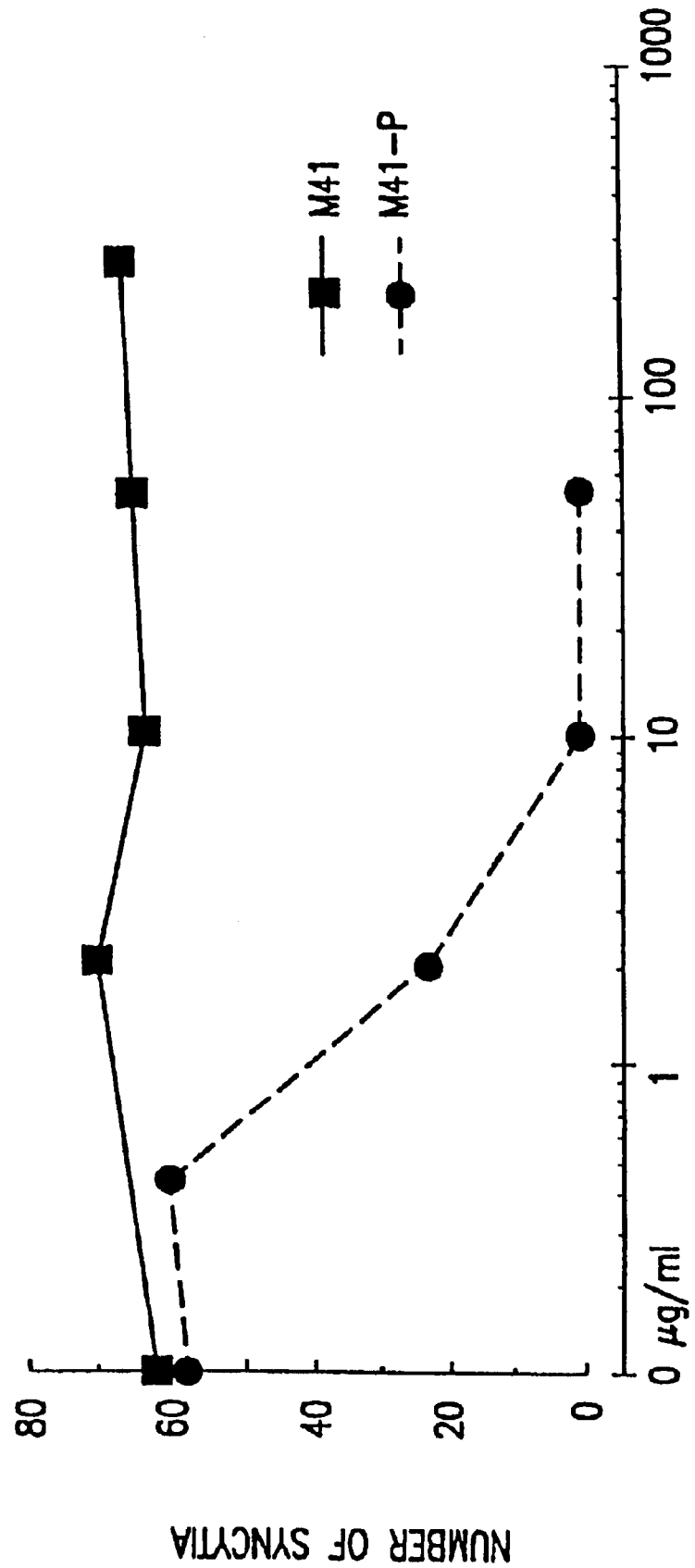

FIG. 8. A point mutation alters the conformation and anti-HIV activity of M41.

Figure 9:
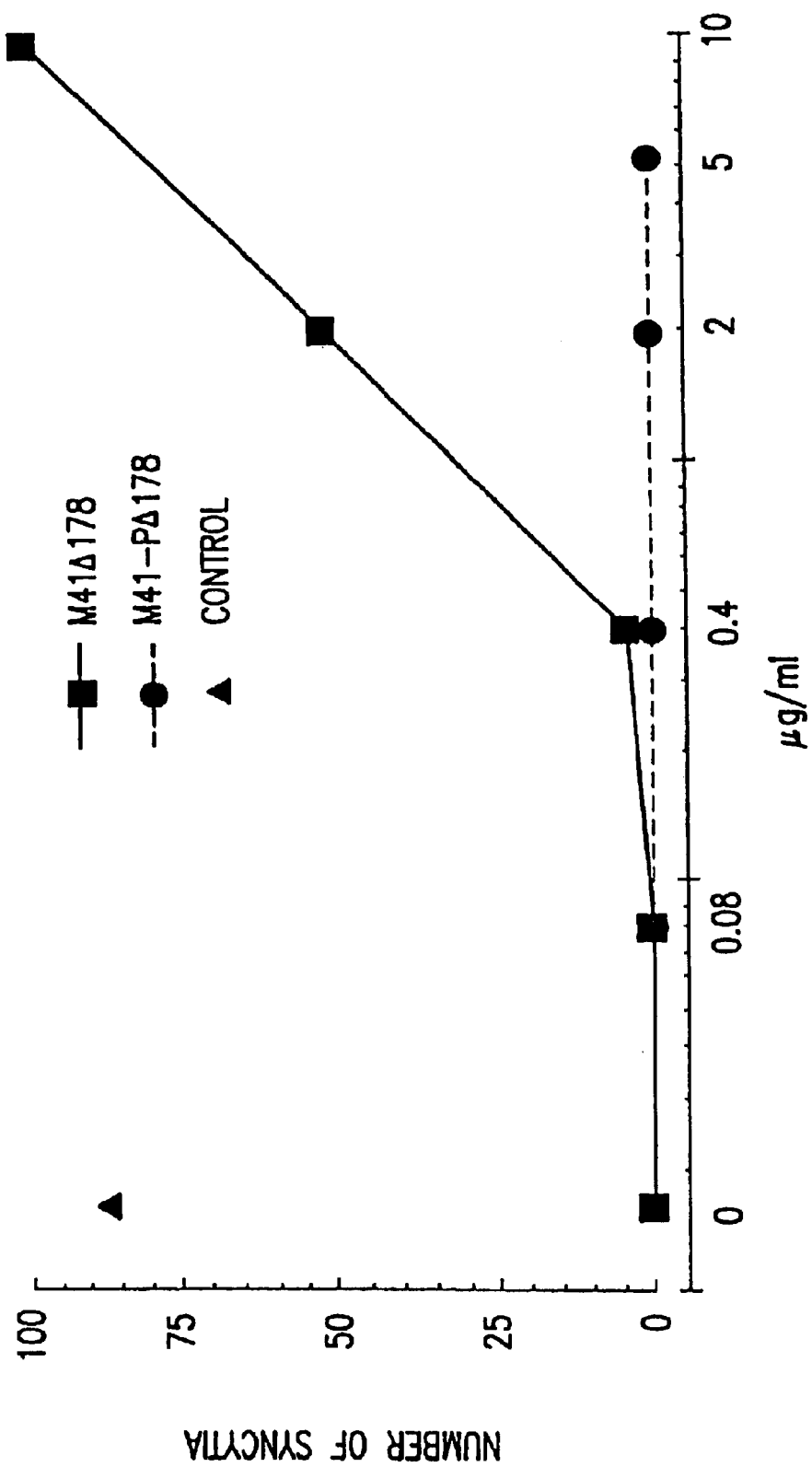

FIG. 9. Abrogation of DP178 anti-HIV activity. Cell fusion assays were carried out in the presence of 10 nM DP178 and various concentrations of M41Δ178 or M41PΔ178.

Figure 10:
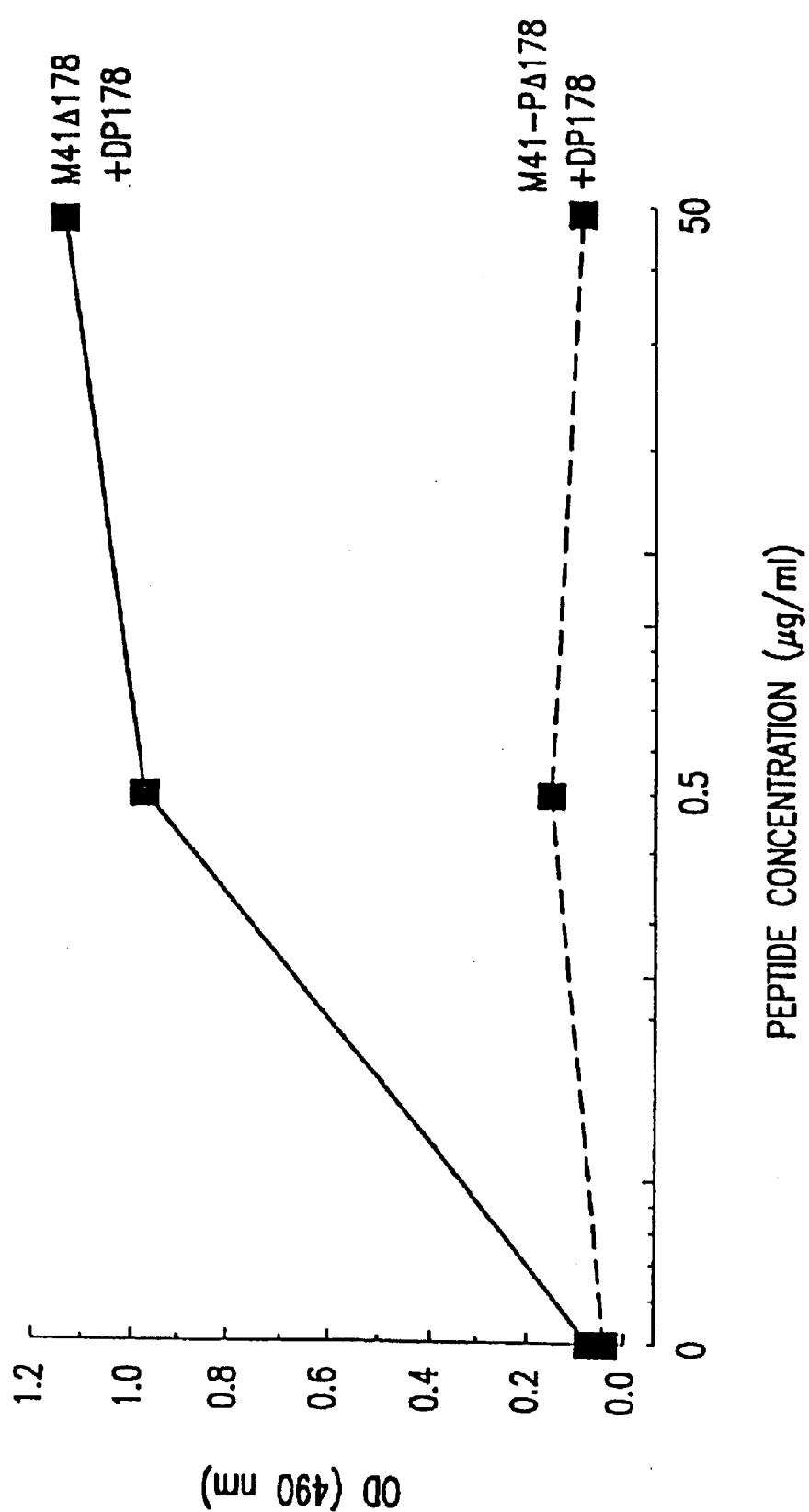

FIG. 10. Binding of DP178 to leucine zipper of gp41 analyzed by FAb-D ELISA.

Figure 11A:
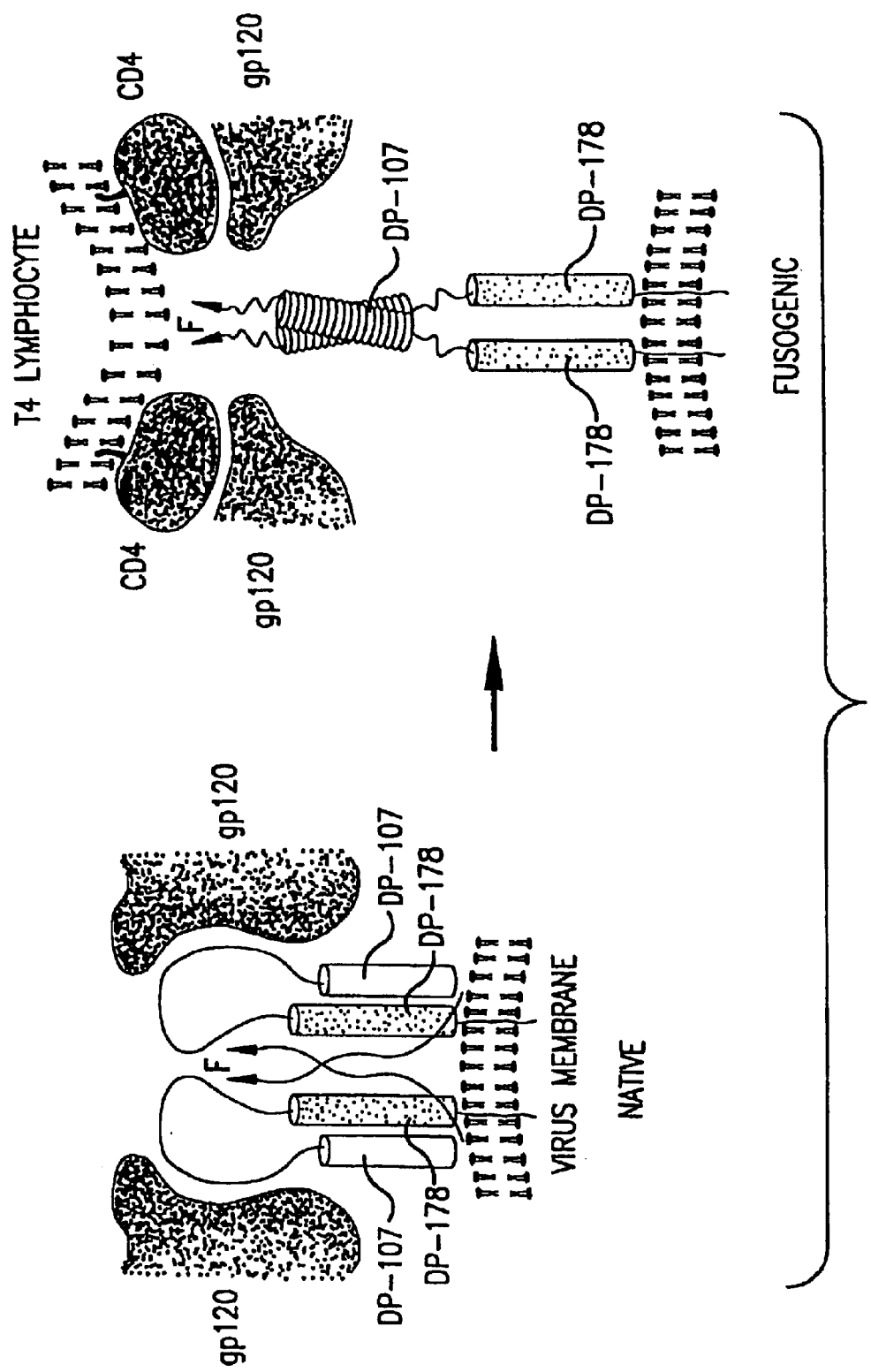
Figure 11B:
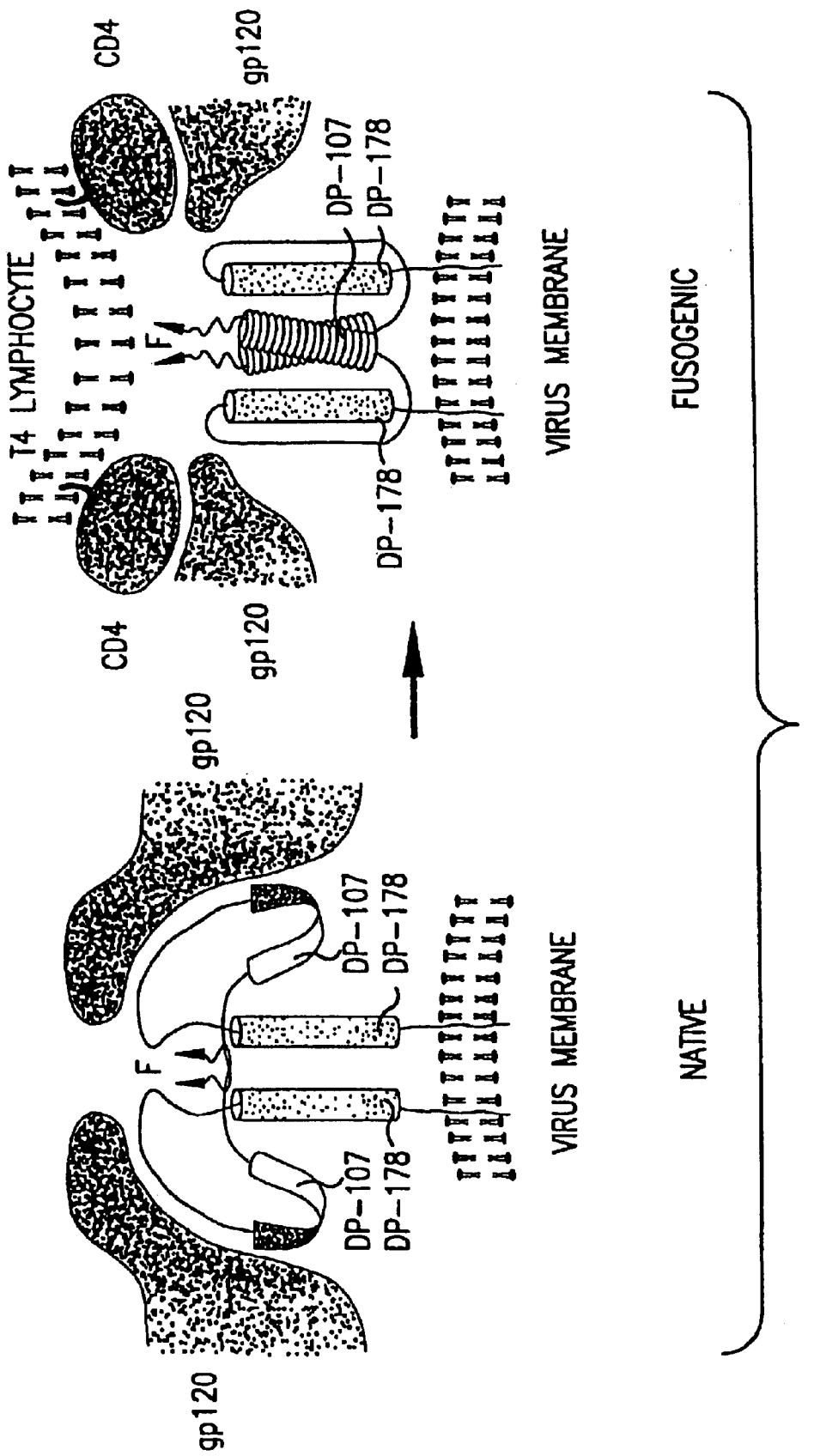

FIGS. 11A–B. Models for a structural transition in the HIV-1 TM protein. Two models are proposed which indicate a structural transition from a native oligomer to a fusogenic state following a trigger event (possibly gp120 binding to CD4). Common features of both models include (1) the native state is held together by nocovalent protein-protein interactions to form the heterodimer of gp120/41 and other interactions, principally though gp41 interactive sties, to form homo-oligomers on the virus surface of the gp120/41 complexes; (2) shielding of the hydrophobic fusogenic peptide at the N-terminus (F) in the native state; and (3) the leucine zipper domain (DP107) exists as a homo-oligomer coiled coil only in the fusogenic state. The major differences in the two models include the structural state (native or fusogenic) in which the DP107 and DP178 domains are complexed to each other. In the first model (FIG. 11A) this interaction occurs in the native state and in the second (FIG. 11B), it occurs during the fusogenic state. When triggered, the fusion complex in the model depicted in (A) is generated through formation of coiled-coil interactions in homologous DP107 domains resulting in an extended α-helix. This conformational change positions the fusion peptide for interaction with the cell membrane. In the second model (FIG. 11B), the fusogenic complex is stabilized by the association of the DP178 domain with the DP107 coiled-coil.

FIG. 12. Motif design using heptad repeat positioning of amino acids of known coiled-coils.

Figure 13:
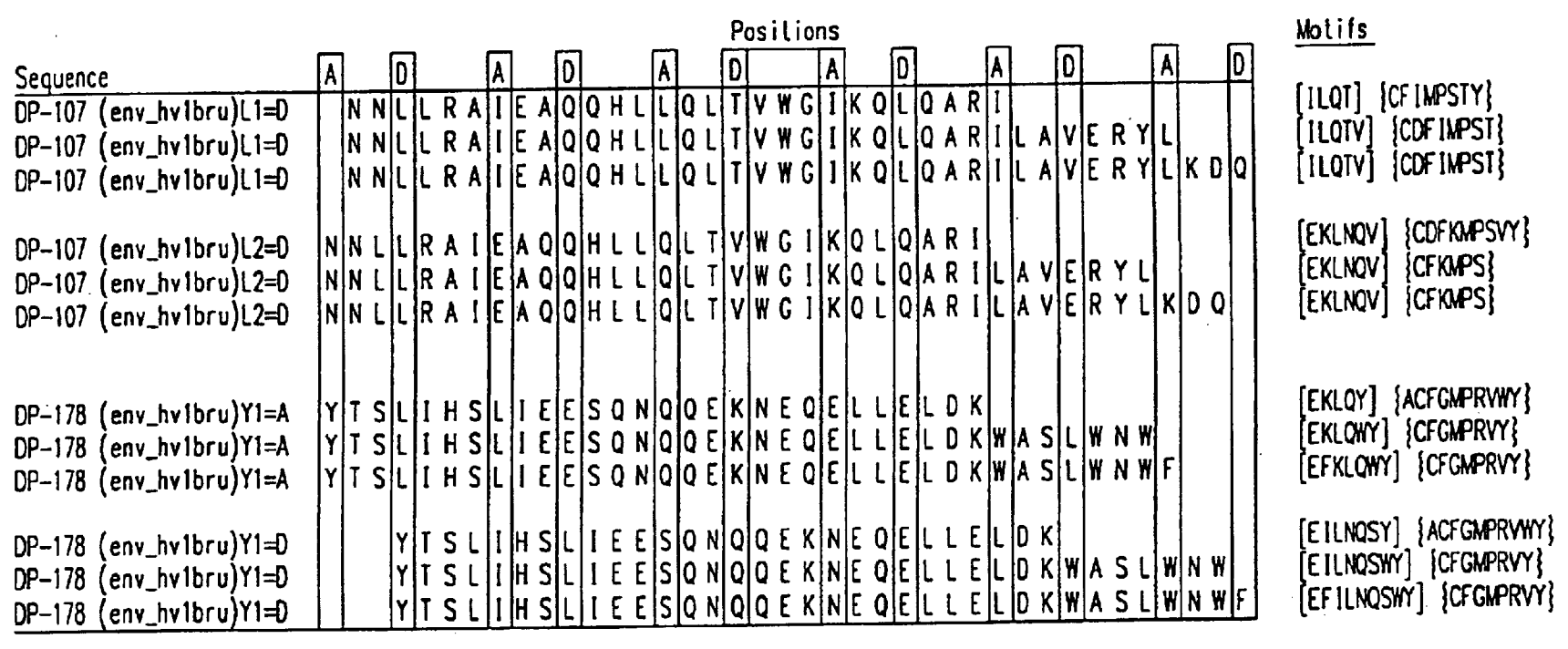

FIG. 13. Motif design using proposed heptad repeat positioning of amino acids of DP107 and DP178.

FIG. 14. Hybrid motif design crossing GCN4 and DP107.

FIG. 15. Hybrid motif design crossing GCN4 and DP178.

FIG. 16. Hybrid motif design 107x178x4, crossing DP107 and DP178. This motif was found to be the most consistent at identifying relevant DP107-like and DP178-like peptide regions.

FIG. 17. Hybrid motif design crossing GCN4, DP107, and DP178.

FIG. 18. Hybrid motif design ALLMOTI5 crossing GCN4, DP107, DP178, c-Fos c-Jun, c-Myc, and Flu Loop 36.

FIG. 19. PLZIP motifs designed to identify N-terminal proline-leucine zipper motifs.

FIG. 20. Search results for HIV-1 (BRU isolate) enveloped protein gp41. Sequence search motif designations: Spades (♠): 107x178x4; Hearts (♥) ALLMOTI5; Clubs (♣): PLZIP; Diamonds (♦): transmembrane region (the putative transmembrane domains were identified using a PC/Gene program designed to search for such peptide regions). Asterisk(*): Lupas method. The amino acid sequences identified by each motif are bracketed by the respective characters. Representative sequences chosen based on 107x178x4 searches are underlined and in bold. DP107 and DP178 sequences are marked, and additionally double-underlined and italicized.

FIG. 21. Search results for human respiratory syncytial virus (RSV) strain A2 fusion glycoprotein F1. Sequence search motif designations are as in FIG. 20.

FIG. 22. Search results for simian immunodeficiency virus (SIV) enveloped protein gp41 (AGM3 isolate). Sequence search motif designations are as in FIG. 20.

FIG. 23. Search results for canine distemper virus (strain Onderstepoort) fusion glycoprotein 1. Sequence search motif designations are as in FIG. 20.

FIG. 24. Search results for newcastle disease virus (strain Australia-Victoria/32) fusion glycoprotein F1. Sequence search motif designations are as in FIG. 20.

FIG. 25. Search results for human parainfluenza 3 virus (strain NIH 47885) fusion glycoprotein F1. Sequence search motif designations are as in FIG. 20.

FIG. 26. Search results for influenza A virus (strain A/AICHI/2/68) hemagglutinin precursor HA2. Sequence search designations are as in FIG. 20.

Figure 27A:
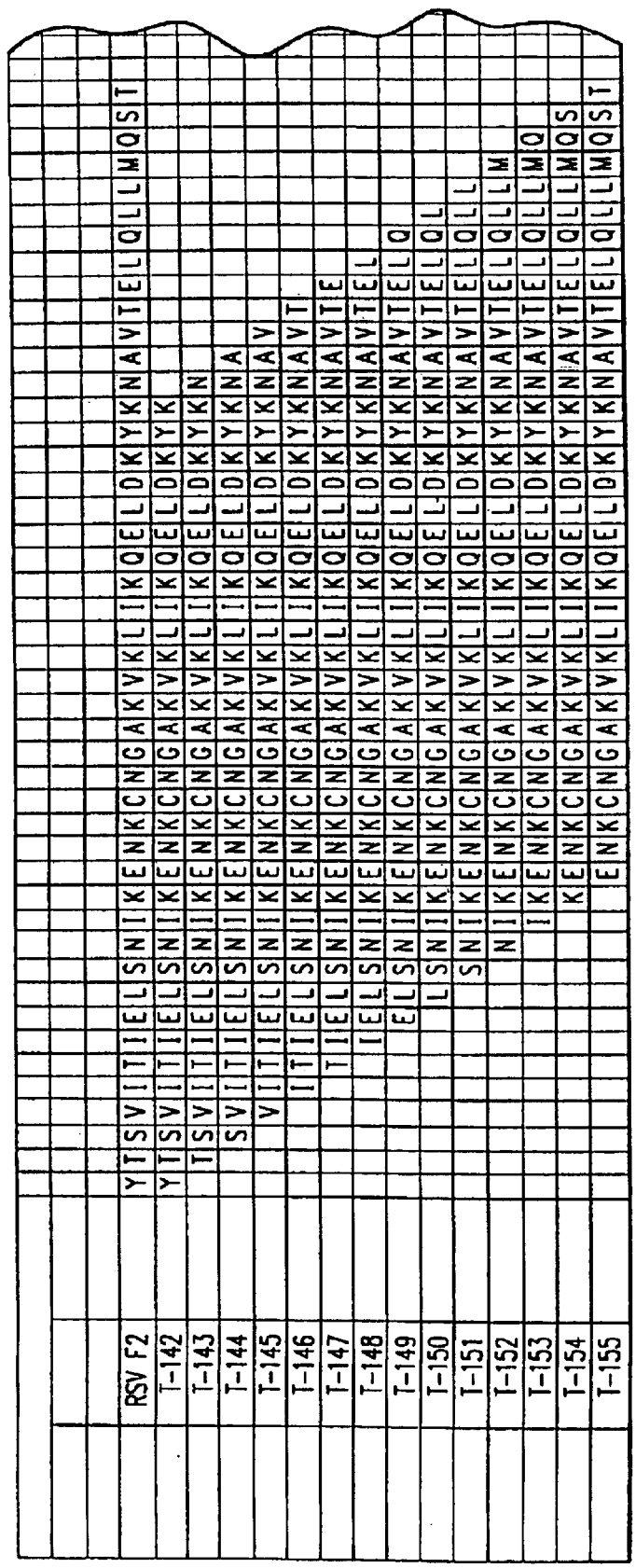

FIGS. 27A–F. Respiratory Syncytial Virus (RSV) peptide antiviral and circular dichroism data. FIGS. 27A–B: Peptides derived from the F2 DP178/DP107-like region. Antiviral and CD data. FIGS. 27C–F: Peptides derived from the F1 DP107-like region. Peptide and CD data.

Antiviral activity (AV) is represented by the following qualitative symbols:

"–", negative antiviral activity;
"+/–", antiviral activity at greater than 100 μg/ml;
"+", antiviral activity at between 50–100 μg/ml;
"++", antiviral activity at between 20–50 μg/ml;
"+++", antiviral activity at between 1–20 μg/ml;
"++++", antiviral activity at <1 μg/ml.

CD data, referring to the level of helicity is represented by the following qualitative symbol:

"–", no helicity;
"+", 25–50% helicity;
"++", 50–75% helicity;
"+++" 75–100% helicity.

$IC_{50}$ refers to the concentration of peptide necessary to produce only 50% of the number of syncytial relative to infected control cultures containing no peptide. $IC_{50}$ values were obtained using purified peptides only.

FIGS. 28A–C. Respiratory Syncytial Virus (RSV) DP178-like region (F1) peptide antiviral and CD data. Antiviral symbols, CD symbols, and $IC_{50}$ are as in FIGS. 27A–F. $IC_{50}$ values were obtained using purified peptides only.

Figure 29A:
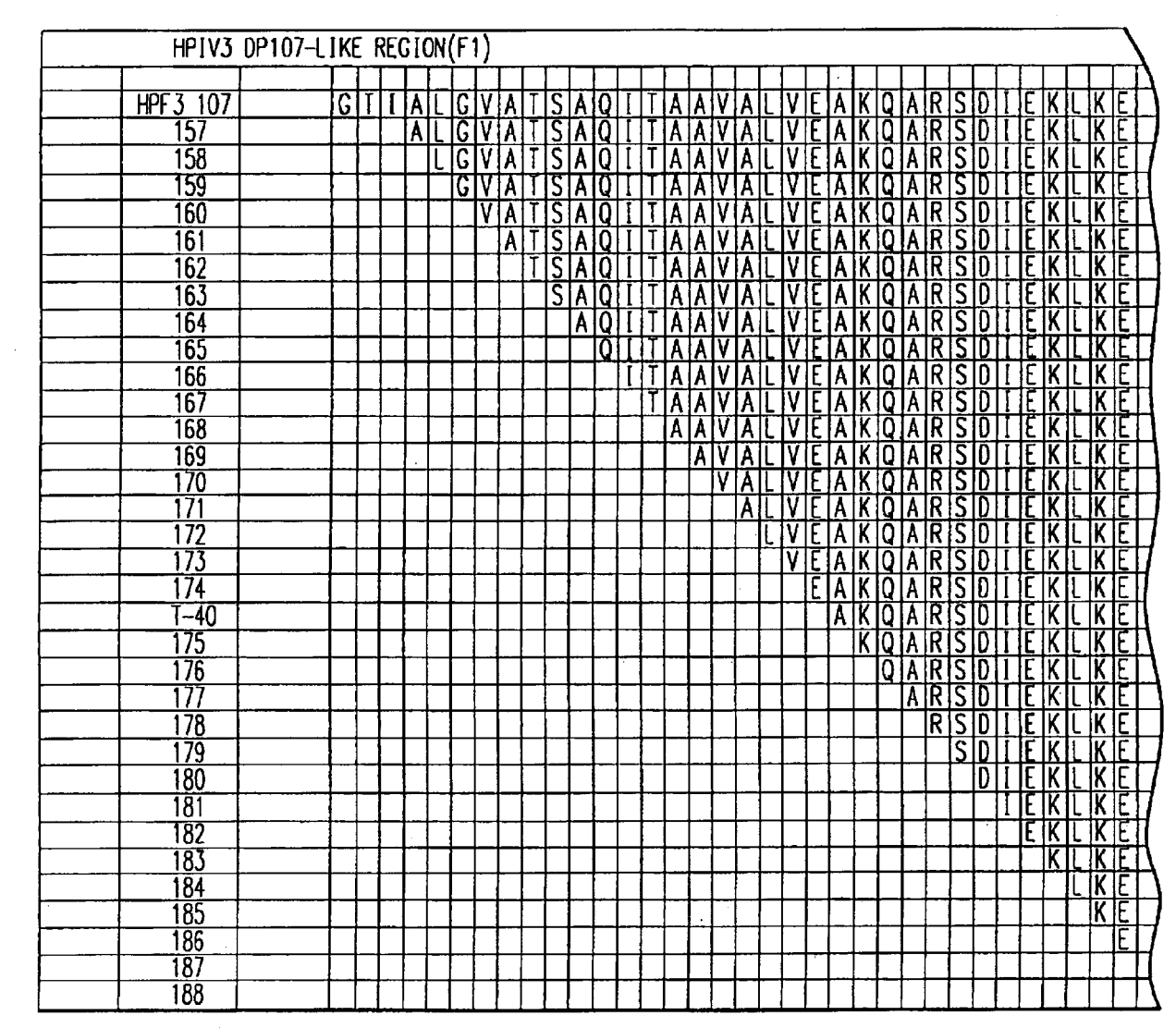

FIGS. 29A–E. Peptides derived from the HPIV3 F1 DP107-like region. Peptide antiviral and CD data. Antiviral symbols, CD symbols, and $IC_{50}$ are as in FIGS. 27A–F. Purified peptides were used to obtain $IC_{50}$ values, except where the values are marked by an asterisk (*), in which cases, the $IC_{50}$ values were obtained using a crude peptide preparation.

FIG. 29C. HPIV3 peptide T-184 CD spectrum at 1° C. in 0.1M NaCl 10 mM $KPO_4$, pH 7.0. The data demonstrates the peptide's helical secondary structure ($\theta_{222/208}$=1.2) over a wide range of concentrations (100–1500 μM). This evidence is consistent with the peptide forming a helical coiled-coil structure.

Figure 30A:
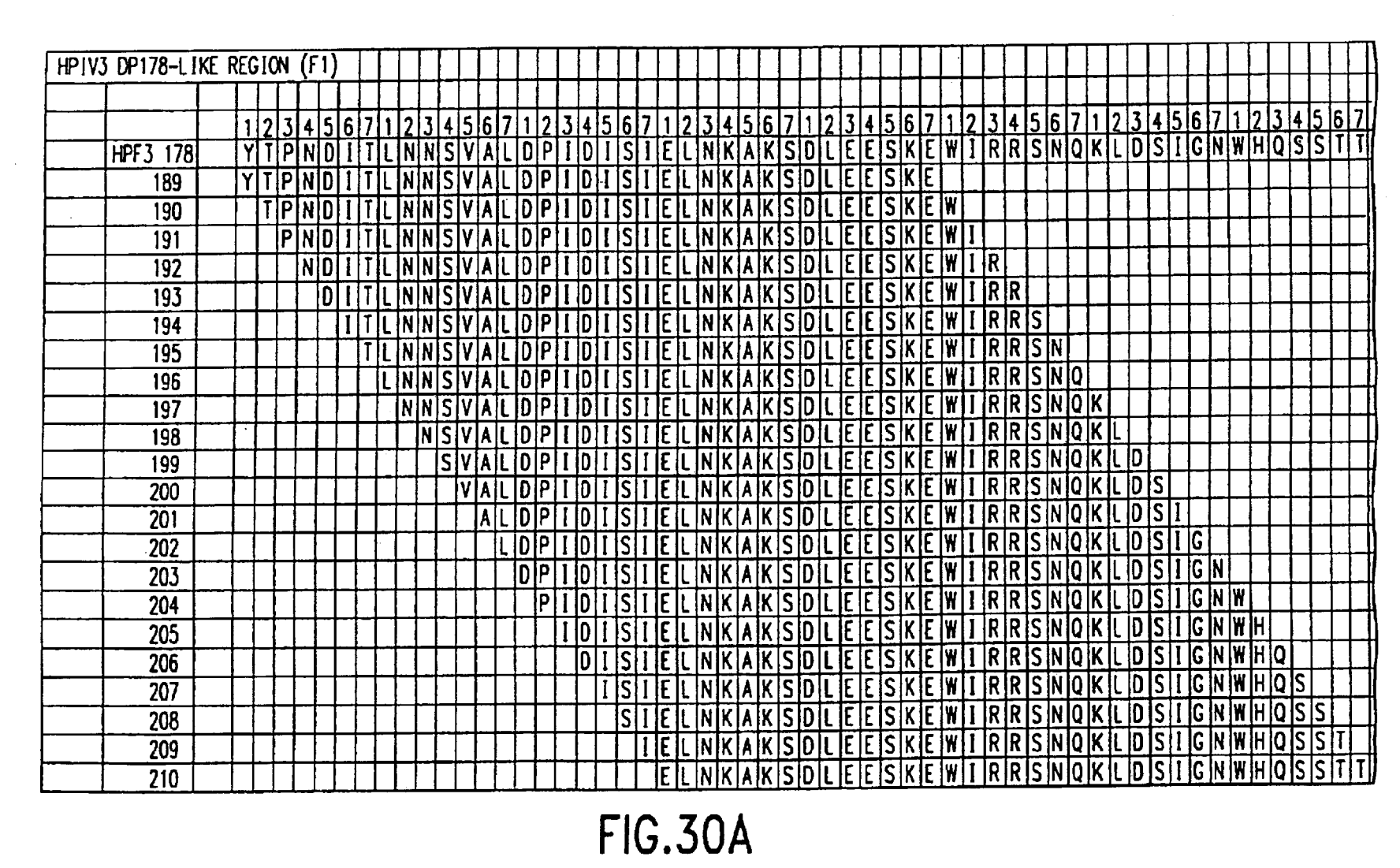

FIGS. 30A–C. Peptides derived from the HPIV3 F1 DP178-like region. Peptide antiviral and CD data. Antiviral symbols, CD symbols, and $IC_{50}$ are as in FIGS. 27A–D. Purified peptides were used to obtain $IC_{50}$ values, except where the values are marked by an asterisk (*), in which cases, the $IC_{50}$ values were obtained using a crude peptide preparation.

FIG. 31. Motif search results for simian immunodeficiency virus (SIV) isolate MM251, enveloped polyprotein gp41. Sequence search designations are as in FIG. 20.

FIG. 32. Motif search results for Epstein-Barr Virus (Strain B95-8), glycoprotein gp110 precursor (designated gp115). BALF4. Sequence search designations are as in FIG. 20.

FIG. 33. Motif search results for Epstein-Barr Virus (Strain B95-8), BZLF1 trans-activator protein (designated EB1 or Zebra). Sequence search designations are as in FIG. 20. Additionally, "@" refers to a well known DNA binding domain and "+" refers to a well known dimerization domain, as defined by Flemington and Speck (Flemington, E. and Speck, S. H., 1990, Proc. Natl. Acad. Sci. UDA 87:9459–9463).

FIG. 34. Motif search results for measles virus (strain Edmonston), fusion glycoprotein F1. Sequence search designations are as in FIG. 20.

FIG. 35. Motif search results for Hepatitis B Virus (Subytpe AYW), major surface antigen precursor S. Sequence search designations are as in FIG. 20.

FIG. 36. Motif search results for simian Mason-Pfizer monkey virus, enveloped (TM) protein gp20. Sequence search designations are as in FIG. 20.

FIG. 37. Motif search results for *Pseudomonas aerginosa*, fimbrial protein (Pilin). Sequence search designations are as in FIG. 20.

FIG. 38. Motif search results for *Neisseria gonorrhoeae* fimbrial protein (Pilin). Sequence search designations are as in FIG. 20.

FIG. 39. Motif search results for *Hemophilus influenzae* fimbrial protein. Sequence search designations are as in FIG. 20.

FIG. 40. Motif search results for *Staphylococcus aureus*, toxic shock syndrome toxin-1. Sequence search designations are as in FIG. 20.

FIG. 41. Motif search results for *Staphylococcus aureus* enterotoxin Type E. Sequence search designations are as in FIG. 20.

FIG. 42. Motif search results for *Staphylococcus aureus* enterotoxin A. Sequence search designations are as in FIG. 20.

FIG. 43. Motif search results for *Escherichia coli*, heat labile enterotoxin A. Sequence search designations are as in FIG. 20.

FIG. 44. Motif search results for human c-fos proto-oncoprotein. Sequence search designations are as in FIG. 20.

FIG. 45. Motif search results for human lupus KU autoantigen protein P70. Sequence search designations are as in FIG. 20.

FIG. 46. Motif search results for human zinc finger protein 10. Sequence search designations are as in FIG. 20.

FIG. 47. Measles virus (MeV) fusion protein DP178-like region antiviral and CD data. Antiviral symbols, CD symbols, and $IC_{50}$ are as in FIGS. 27A–F. $IC_{50}$ values were obtained using purified peptides.

FIG. 48. Simian immunodeficiency virus (SIV) TM (fusion) protein DP178-like region antiviral data. Antiviral symbols are as in FIG. 27A–F "NT", not tested.

FIGS. 49A–L. DP178-derived peptide antiviral data. The peptides listed herein were derived from the region surrounding the HIV-1 BRU isolate DP178 region (e.g., gp41 amino acid residues 615–717).

Figure 49C:
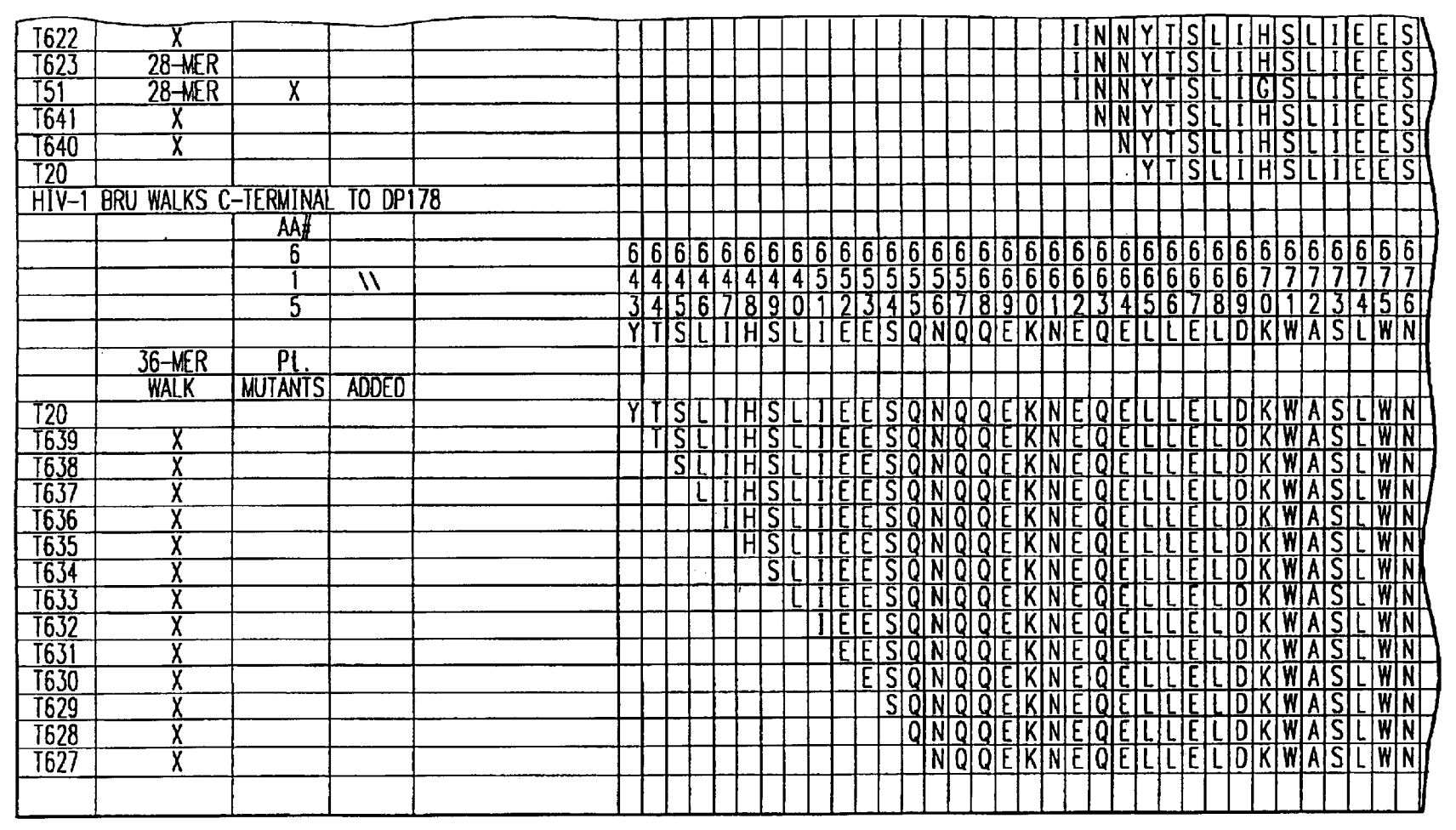
Figure 49D:
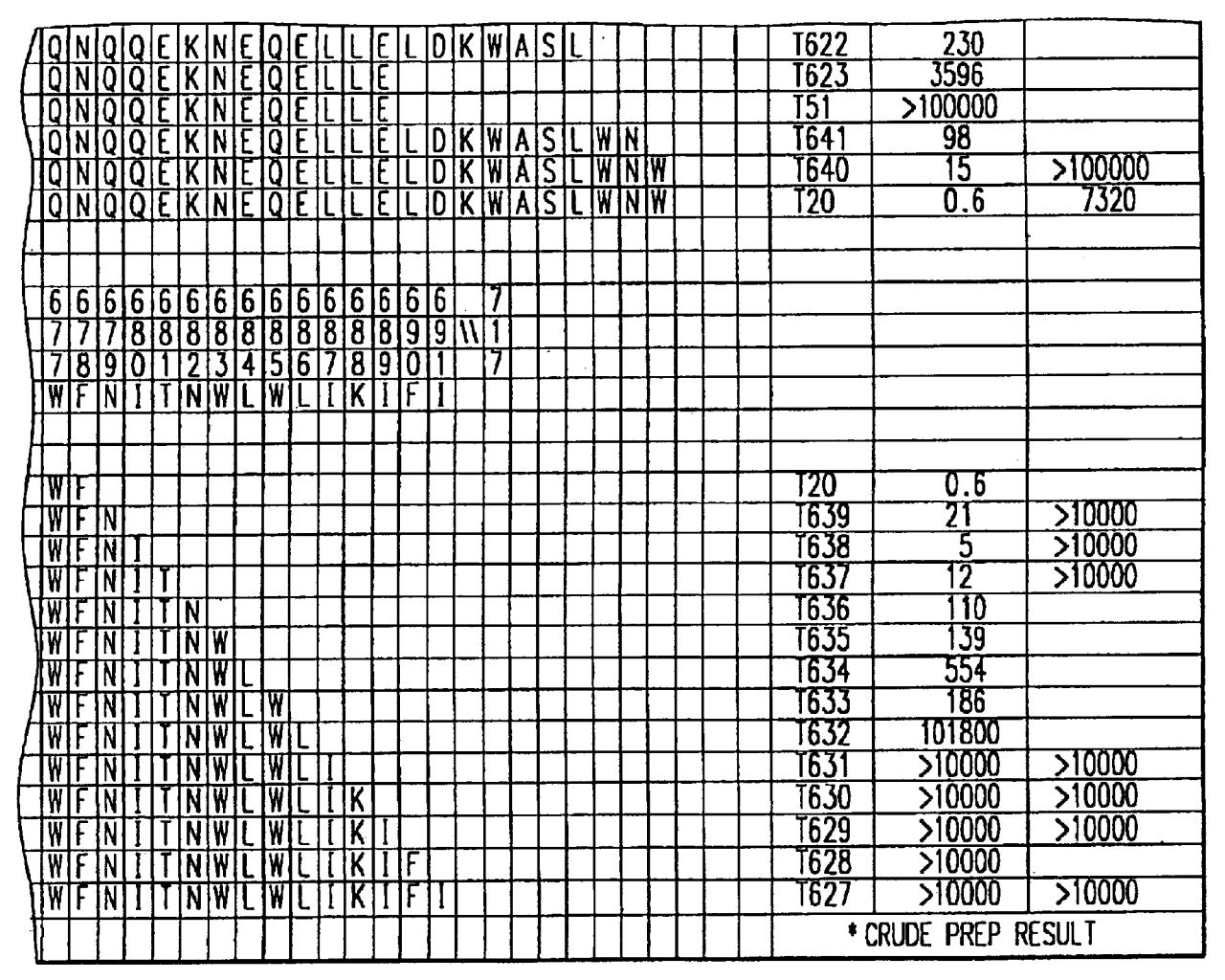
Figure 49I:
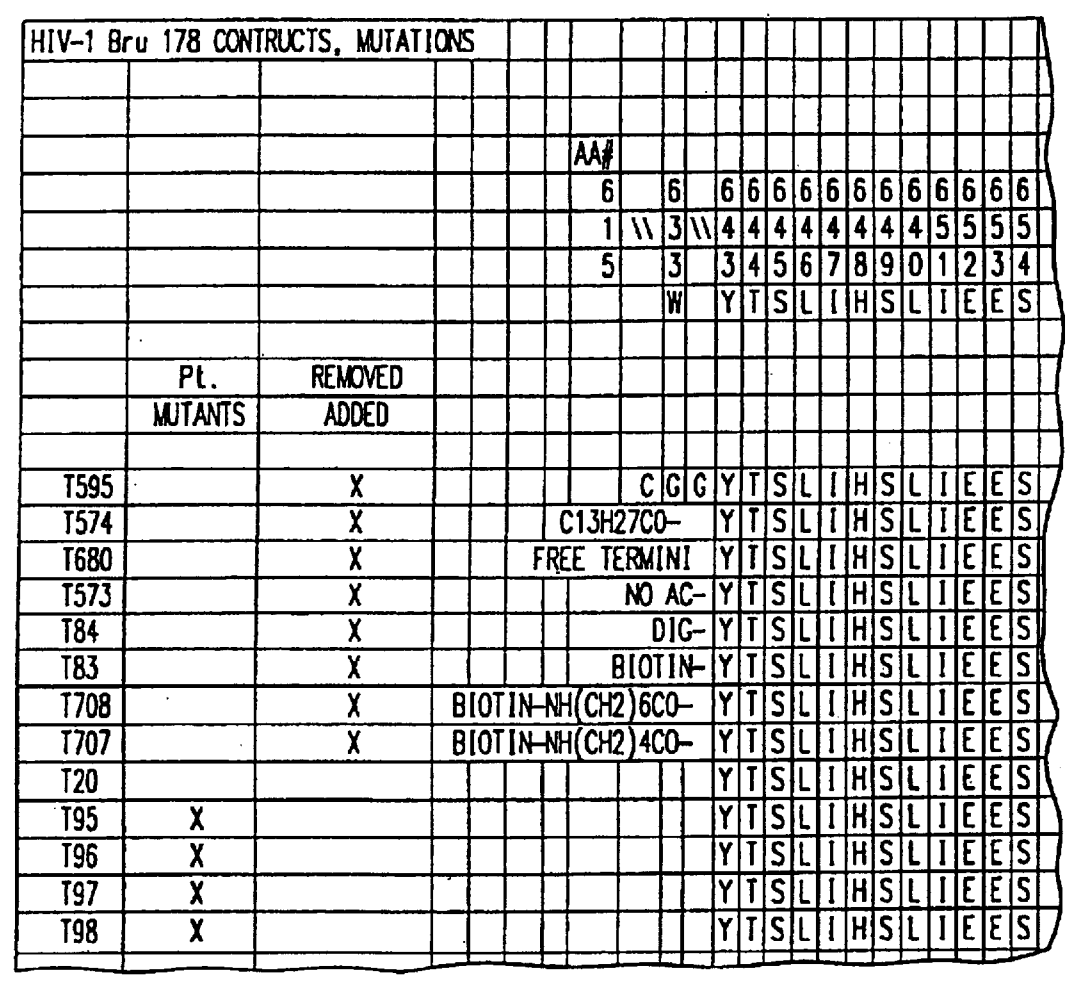

In instances where peptides contained DB178 point mutations, the mutated amino acid residues are shown with a shaded background. In instances in which the test peptide has had an amino and/or carboxy-terminal group added or removed (apart from the standard amido- and acetyl-blocking groups found on such peptides), such modifications are indicated. FIG. 49A: The column to the immediate right of the name of the test peptide indicates the size of the test peptide and points out whether the peptide is derived from a one amino acid peptide "walk" across the DP178 region. The next column to the right indicates whether the test peptide contains a point mutation, while the column to its right indicates whether certain amino acid residues have been added to or removed from the DP178-derived amino acid sequence. FIG. 49B: The column to the immediate right of the test peptide name indicates whether the peptide represents a DP178 truncation, the next column to the right points out whether the peptide contains a point mutation, and the column to its right indicates whether the peptide contains amino acids which have been added to or removed from the DP178 sequence itself. FIG. 49C: The column to the immediate right of the test peptide name indicates whether the test peptide contains a point mutation, while the column to its right indicates whether amino acid residues have been added to or removed from the DP178 sequence itself. $IC_{50}$ is as defined in FIGS. 27A–F, and $IC_{50}$ values were obtained using purified peptides except where marked with an asterisk (*), in which case the $IC_{50}$ was obtained using a crude peptide preparation.

FIG. 50. DP107 and DP107 gp41 region truncated peptide antiviral data. $IC_{50}$ as defined in FIGS. 27A–F, and $IC_{50}$ values were obtained using purified peptides except where marked with an asterisk (*), in which case the $IC_{50}$ was obtained using a crude peptide preparation.

FIGS. 51A–C. Epstein-Barr virus Strain B95-8 BZLF1 DP178/DP107 analog region peptide walks and electrophoretic mobility shift assay results. The peptides (T-423 to T-446, FIG. 51A; T-447 to T-461, FIG. 51B) represent one amino acid residue "walks" through the EBV Zebra protein region from amino acid residue 173 to 246.

The amino acid residue within this region which corresponds to the first amino acid residue of each peptide is listed to the left of each peptide, while the amino acid residue within this region which corresponds to the last amino acid residue of each peptide is listed to the right of each peptide. The length of each test peptide is listed at the far right of each line, under the heading "Res".

"ACT" refers to a test peptide's ability to inhibit Zebra binding to its response element. "+" refers to a visible, but incomplete, abrogation of the response element/Zebra homodimer complex; "+++" refers to a complete abrogation of the complex; and "−" represents a lack of complex disruption.

FIGS. 52A–B. Hepatitis B virus subtype AYW major surface antigen precursor S protein DP178/DP107 analog region and peptide walks. 52A depicts Domain I (S protein amino acid residues 174–220), which contains a potential DP178/DP107 analog region. In addition, peptides are listed which represent one amino acid peptide "walks" through domain I. 52B depicts Domain II (S protein amino acid residues 233–291), which contains a second potential DP178/DP107 analog region. In addition, peptides are listed which represent one amino acid peptide "walks" through domain II.

FIG. 53: Cell fusion and competitive inhibition data for alanine walk experiments for the DP178-like Respiratory Syncytial Virus (RSV) peptide T112.

FIG. 54: Circular dichroism, cell fusion and competitive inhibition data for alanine walk experiments for the peptide T20, which is also known as DP178.

5. DETAILED DESCRIPTION OF THE INVENTION

Described herein are peptides which may exhibit antifusogenic activity, antiviral capability, and/or the ability to modulate intracellular processes involving coiled-coil peptide structures. The peptides described include, first, DP178 (SEQ ID NO:1), a gp41-derived 36 amino acid peptide and fragments and analogs of DP178.

In addition, the peptides of the invention described herein include peptides which are DP107 analogs. DP107 (SEQ ID NO:25) is a 38 amino acid peptide corresponding to residues 558 to 595 of the HIV-1$_{LAI}$ transmembrane (TM) gp41 protein. Such DP107 analogs may exhibit antifusogenic capability, antiviral activity or an ability to modulate intracellular processes involving coiled-coil structures.

Further, peptides of the invention include DP107 and DP178 are described herein having amino acid sequences recognized by the 107×178×4, ALLMOTI5, and PLZIP search motifs. Such motifs are also discussed.

Also described here are antifusogenic, antiviral, intracellular modulatory, and diagnostic uses of the peptides of the invention. Further, procedures are described for the use of the peptides of the invention for the identification of compounds exhibiting antifusogenic, antiviral or intracellular modulatory activity.

While not limited to any theory of operation, the following model is proposed to explain the potent anti-HIV activity of DP178, based, in part, on the experiments described in the Examples, infra. In the HIV protein, gp41, DP178 corresponds to a putative α-helix region located in the C-terminal end of the gp41 ectodomain, and appears to associate with a distal site on gp41 whose interactive structure is influenced by the leucine zipper motif, a coiled-coil structure, referred to as DP107. The association of these two domains may reflect a molecular linkage or "molecular clasp" intimately involved in the fusion process. It is of interest that mutations in the C-terminal α-helix motif of gp41 (i.e., the D178 domain) tend to enhance the fusion ability of gp41, whereas mutations in the leucine zipper region (i.e., the DP107 domain) decrease or abolish the fusion ability of the viral protein. It may be that the leucine zipper motif is involved in membrane fusion while the C-terminal α-helix motif serves as a molecular safety to regulate the availability of the leucine zipper during virus-induced membrane fusion.

On the basis of the foregoing, two models are proposed of gp41-mediated membrane fusion which are schematically shown in FIG. 11A–B. The reason for proposing two models is that the temporal nature of the interaction between the regions defined by DP107 and DP178 cannot, as yet, be pinpointed. Each model envisions two conformations for gp41—one in a "native" state as it might be found on a resting virion. The other in a "fusogenic" state to reflect conformational changes triggered following binding of gp120 to CD4 and just prior to fusion with the target cell membrane. The strong binding affinity between gp120 and CD4 may actually represent the trigger for the fusion process obviating the need for a pH change such as occurs for viruses that fuse within intracellular vesicles. The two major features of both models are: (1) the leucine zipper sequences (DP107) in each chain of oligomeric enveloped are held apart in the native state and are only allowed access to one another in the fusogenic state so as to form the extremely stable coiled-coils, and (2) association of the DP178 and DP107 sites as they exist in gp41 occur either in the native or fusogenic state. FIG. 11A depicts DP178/DP107 interaction in the native state as a molecular clasp. On the other hand, if one assumes that the most stable form of the enveloped occurs in the fusogenic state, the model in FIG. 11B can be considered.

When synthesized as peptides, both DP107 and DP178 are potent inhibitors of HIV infection and fusion, probably by virtue of their ability to form complexes with viral gp41 and interfere with its fusogenic process; e.g., during the structural transition of the viral protein from the native structure to the fusogenic state, the DP178 and DP107 peptides may gain access to their respective binding sites on the viral gp41, and exert a disruptive influence. DP107 peptides which demonstrate anti-HIV activity are described in Applicants' co-pending application Ser. No. 08/264,531, filed Jun. 23, 1994, which is incorporated by reference herein in its entirety.

As shown in the Examples, infra, a truncated recombinant gp41 protein corresponding to the ectodomain of gp41 containing both DP107 and DP178 domains (excluding the fusion peptide, transmembrane region and cytoplasmic domain of gp41) did not inhibit HIV-1 induced fusion. However, when a single mutation was introduced to disrupt the coiled-coil structure of the DP107 domain—a mutation which results in a total loss of biological activity of DP107 peptides—the inactive recombinant protein was transformed to an active inhibitor of HIV-1 induced fusion. This transformation may result from liberation of the potent DP178 domain from a molecular clasp with the leucine zipper, DP107 domain.

For clarity of discussion, the invention will be described primarily for DP178 peptide inhibitors of HIV. However, the principles may be analogously applied to other viruses, both enveloped and nonenveloped, and to other non-viral organisms.

5.1. DP178 and DP178-Like Peptides

The DP178 peptide (SEQ ID:1) of the invention corresponds to amino acid residues 638 to 673 of the transmembrane protein gp41 from the HIV-1$_{LAI}$ isolate, and has the 36 amino acid sequence (reading from amino to carboxy terminus):

NH$_2$-YTSLIHSLIEESQNQQEKNEQELLELDKWASLWNWF—COOH (SEQ ID:1)

In addition to the full-length DP178 (SEQ ID:1) 36-mer, the peptides of the invention may include truncations of the DP178 (SEQ ID:1) peptide which exhibit antifusogenic activity, antiviral activity and/or the ability to modulate intracellular processes involving coil-coil peptide structures. Truncations of DP178 (SEQ ID:1) peptides may comprise peptides of between 3 and 36 amino acid residues (i.e., peptides ranging in size from a tripeptide to a 36-mer polypeptide), as shown in Tables I and IA, below. Peptide sequences in these tables are listed from amino (left) to carboxy (right) terminus. "X" may represent an amino group (—NH$_2$) and "Z" may represent a carboxyl (—COOH) group. Alternatively, "X" may represent a hydrophobic group, including but not limited to carbobenzyl, dansyl, or T-butoxycarbonyl; an acetyl group; a 9-fluorenylmethoxycarbonyl (FMOC) group; or a covalently attached macromolecular group, including but not limited to a lipid-fatty acid conjugate, polyethylene glycol, carbohydrate or peptide group. Further, "Z" may represent an amido group; a T-butoxycarbonyl group; or a covalently attached macromolecular group, including but not limited to a lipid-fatty acid conjugate, polyethylene glycol, carbohydrate or peptide group. A preferred "X" or "Z" macromolecular group is a peptide group.

TABLE I

DP178 (SEQ ID:1) CARBOXY TRUNCATIONS

```
X-YTS-Z
X-YTSL-Z
X-YTSLI-Z
X-YTSLIH-Z
X-YTSLIHS-Z
X-YTSLIHSL-Z
X-YTSLIHSLI-Z
X-YTSLIHSLIE-Z
X-YTSLIHSLIEE-Z
X-YTSLIHSLIEES-Z
X-YTSLIHSLIEESQ-Z
X-YTSLTHSLIEESQN-Z
X-YTSLIHSLIEESQNQ-Z
X-YTSLIHSLIEESQNQQ-Z
X-YTSLIHSLIEESQNQQE-Z
X-YTSLIHSLIEESQNQQEK-Z
X-YTSLIHSLIEESQNQQEKN-Z
X-YTSLIHSLIEESQNQQEKNE-Z
X-YTSLIHSLIEESQNQQEKNEQ-Z
X-YTSLIHSLIEESQNQQEKNEQE-Z
X-YTSLIHSLIEESQNQQEKNEQEL-Z
X-YTSLIHSLIEESQNQQEKNEQELL-Z
X-YTSLIHSLIEESQNQQEKNEQELLE-Z
X-YTSLIHSLIEESQNQQEKNEQELLEL-Z
X-YTSLIHSLIEESQNQQEKNEQELLELD-Z
X-YTSLIHSLIEESQNQQEKNEQELLELDK-Z
X-YTSLIHSLIEESQNQQEKNEQELLELDKW-Z
X-YTSLIHSLIEESQNQQEKNEQELLELDKWA-Z
X-YTSLIHSLIEESQNQQEKNEQELLELDKWAS-Z
X-YTSLIHSLIEESQNQQEKNEQELLELDKWASL-Z
X-YTSLIHSLIEESQNQQEKNEQELLELDKWASLW-Z
X-YTSLIHSLTEESQNQQEKNEQELLELDKWASLWN-Z
X-YTSLIHSLIEESQNQQEKNEQELLELDKWASLWNW-Z
X-YTSLIHSLIEESQNQQEKNEQELLELDKWASLWNWF-Z
```

The one letter amino acid code is used.

TABLE IA

DP178 (SEQ ID:1) AMINO TRUNCATIONS

```
X-NWF-Z
X-WNWF-Z
X-LWNWF-Z
X-SLWNWF-Z
X-ASLWNWF-Z
X-WASLWNWF-Z
X-KWASLWNWF-Z
X-DKWASLWNWF-Z
X-LDKWASLWNWF-Z
X-ELDKWASLWNWF-Z
X-LELDKWASLWNWF-Z
X-LLELDKWASLWNWF-Z
X-ELLELDKWASLWNWF-Z
X-QELLELDKWASLWNWF-Z
X-EQELLELDKWASLWNWF-Z
X-NEQELLELDKWASLWNWF-Z
X-KNEQELLELDKWASLWNWF-Z
X-EKNEQELLELDKWASLWNWF-Z
X-QEKNEQELLELDKWASLWNWF-Z
X-QQEKNEQELLELDKWASLWNWF-Z
X-NQQEKNEQELLELDKWASLWNWF-Z
X-QNQQEKNEQELLELDKWASLWNWF-Z
X-SQNQQEKNEQELLELDKWASLWNWF-Z
X-ESQNQQEKNEQELLELDKWASLWNWF-Z
X-EESQNQQEKNEQELLELDKWASLWNWF-Z
X-IEESQNQQEKNEQELLELDKWASLWNWF-Z
X-LIEESQNQQEKNEQELLELDKWASLWNWF-Z
X-SLIEESQNQQEKNEQELLELDKWASLWNWF-Z
```

TABLE IA-continued

DP178 (SEQ ID:1) AMINO TRUNCATIONS

```
X-HSLIEESQNQQEKNEQELLELDKWASLWNWF-Z
X-IHSLIEESQNQQEKNEQELLELDKWASLWNWF-Z
X-LIHSLIEESQNQQEKNEQELLELDKWASLWNWF-Z
X-SLIHSLIEESQNQQEKNEQELLELDKWASLWNWF-Z
X-TSLIHSLIEESQNQQEKNEQELLELDKWASLWNWF-Z
X-YTSLIHSLIEESQNQQEKNEQELLELDKWASLWNWF-Z
```

The one letter amino acid code is used.

The peptides of the invention also include DP178-like peptides. "DP178-like", as used herein, refers, first, to DP178 and DP178 truncations with contain one or more amino acid substitutions, insertions and/or deletions. Second, "DP-178-like" refers to peptide sequences identified or recognized by the ALLMOTI5, 107×178×4 and PLZIP search motifs described herein, having structural and/or amino acid motif similarity to DP178. The DP178-like peptides of the invention may exhibit antifusogenic or antiviral activity, or may exhibit the ability to modulate intracellular processes involving coiled-coil peptides. Further, such DP178-like peptides may possess additional advantageous features, such as, for example, increased bioavailability, and/or stability, or reduced host immune recognition.

HIV-1 and HIV-2 enveloped proteins are structurally distinct, but there exists a striking amino acid conservation within the DP178-corresponding regions of HIV-1 and HIV-2. The amino acid conservation is of a periodic nature, suggesting some conservation of structure and/or function. Therefore, one possible class of amino acid substitutions would include those amino acid changes which are predicted to stabilize the structure of the DP178 peptides of the invention. Utilizing the DP178 and DP178 analog sequences described herein, the skilled artisan can readily compile DP178 consensus sequences and ascertain from these, conserved amino acid residues which would represent preferred amino acid substitutions.

The amino acid substitutions may be of a conserved or non-conserved nature. Conserved amino acid substitutions consist of replacing one or more amino acids of the DP178 (SEQ ID:1) peptide sequence with amino acids of similar charge, size, and/or hydrophobicity characteristics, such as, for example, a glutamic acid (E) to aspartic acid (D) amino acid substitution. Non-conserved substitutions consist of replacing one or more amino acids of the DP178 (SEQ ID:1) peptide sequence with amino acids possessing dissimilar charge, size, and/or hydrophobicity characteristics, such as, for example, a glutamic acid (E) to valine (V) substitution.

Amino acid insertions may consist of single amino acid residues or stretches of residues. The insertions may be made at the carboxy or amino terminal end of the DP178 or DP178 truncated peptides, as well as at a position internal to the peptide. Such insertions will generally range from 2 to 15 amino acids in length. It is contemplated that insertions made at either the carboxy or amino terminus of the peptide of interest may be of a broader size range, with about 2 to about 50 amino acids being preferred. One or more such insertions may be introduced into DP178 (SEQ. ID:1) or DP178 truncations, as long as such insertions result in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures.

Preferred amino or carboxy terminal insertions are peptides ranging from about 2 to about 50 amino acid residues in length, corresponding to gp41 protein regions either amino to or carboxy to the actual DP178 gp41 amino acid sequence, respectively. Thus, a preferred amino terminal or carboxy terminal amino acid insertion would contain gp41 amino acid sequences found immediately amino to or carboxy to the DP178 region of the gp41 protein.

Deletions of DP178 (SEQ ID:1) or DP178 truncations are also within the scope of the invention. Such deletions consist of the removal of one or more amino acids from the DP178 or DP178-like peptide sequence, with the lower limit length of the resulting peptide sequence being 4 to 6 amino acids. Such deletions may involve a single contiguous or greater than one discrete portion of the peptide sequences. One or more such deletions may be introduced into DP178 (SEQ.ID:1) or DP178 truncations, as long as such deletions results in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures.

DP178 analogs are further described, below, in Section 5.3.

5.2. DP107 and DP107-Like Peptides

Further, the peptides of the invention include peptides having amino acid sequences corresponding to DP107 analogs. DP107 is a 38 amino acid peptide which exhibits potent antiviral activity, and corresponds to residues 558 to 595 of HIV-$1_{LAI}$ transmembrane (TM) gp41 protein, as shown here:

$NH_2$-NNLLRAIEAQQHLLQLTVWQIKQLQA-RILAVERYLKDQ—COOH (SEQ ID:25)

In addition to the full-length DP107 (SEQ ID:25) 38-mer, the peptides of the invention may include truncations of the DP107 (SEQ ID:25) peptide which exhibit antifusogenic activity, antiviral activity and/or the ability to modulate intracellular processes involving coiled-coil peptide structures. Truncations of DP107 (SEQ ID:25) peptides may comprise peptides of between 3 and 38 amino acid residues (i.e., peptides ranging in size from a tripeptide to a 38-mer polypeptide), as shown in Tables II and IIA, below. Peptide sequences in these tables are listed from amino (left) to carboxy (right) terminus. "X" may represent an amino group (—$NH_2$) and "Z" may represent a carboxyl (—COOH) group. Alternatively, "X" may represent a hydrophobic group, including but not limited to carbobenzyl, dansyl, or T-butoxycarbonyl; an acetyl group; a 9-fluorenylmethoxy-carbonyl (FMOC) group; or a covalently attached macromolecular group, including but not limited to a lipid-fatty acid conjugate, polyethylene glycol, carbohydrate or peptide group. Further, "Z" may represent an amido group; a T-butoxycarbonyl group; or a covalently attached macromolecular group, including but not limited to a lipid-fatty acid conjugate, polyethylene glycol, carbohydrates or peptide group. A preferred "X" or "Z" macromolecular group is a peptide group.

TABLE II

| DP107 (SEQ ID:25) CARBOXY TRUNCATIONS |
|---|
| X-NNL-Z |
| X-NNLL-Z |
| X-NNLLR-Z |
| X-NNLLRA-Z |
| X-NNLLRAI-Z |
| X-NNLLRAIE-Z |
| X-NNLLRAIEA-Z |
| X-NNLLRAIEAQ-Z |
| X-NNLLRAIEAQQ-Z |
| X-NNLLRAIEAQQH-Z |
| X-NNLLRAIEAQQHL-Z |
| X-NNLLRAIEAQQHLL-Z |
| X-NNLLRAIEAQQHLLQ-Z |
| X-NNLLRAIEAQQHLLQL-Z |
| X-NNLLRAIEAQQHLLQLT-Z |
| X-NNLLRAIEAQQHLLQLTV-Z |
| X-NNLLRAIEAQQHLLQLTVW-Z |
| X-NNLLRAIEAQQHLLQLTVWQ-Z |
| X-NNLLRAIEAQQHLLQLTVWQI-Z |
| X-NNLLRAIEAQQHLLQLTVWQIK-Z |
| X-NNLLRAIEAQQHLLQLTVWQIKQ-Z |
| X-NNLLRAIEAQQHLLQLTVWQIKQL-Z |
| X-NNLLRAIEAQQHLLQLTVWQIKQLQ-Z |
| X-NNLLRAIEAQQHLLQLTVWQIKQLQA-Z |
| X-NNLLRAIEAQQHLLQLTVWQIKQLQAR-Z |
| X-NNLLRAIEAQQHLLQLTVWQIKQLQARI-Z |
| X-NNLLRAIEAQQHLLQLTVWQIKQLQARIL-Z |
| X-NNLLRAIEAQQHLLQLTVWQIKQLQARILA-Z |
| X-NNLLRAIEAQQHLLQLTVWQIKQLQARILAV-Z |
| X-NNLLRAIEAQQHLLQLTVWQIKQLQARILAVE-Z |
| X-NNLLRAIEAQQHLLQLTVWQIKQLQARILAVER-Z |
| X-NNLLRAIEAQQHLLQLTVWQIKQLQARILAVERY-Z |
| X-NNLLRAIEAQQHLLQLTVWQIKQLQARILAVERYL-Z |
| X-NNLLRAIEAQQHLLQLTVWQIKQLQARILAVERYLK-Z |
| X-NNLLRAIEAQQHLLQLTVWQIKQLQARILAVERYLKD-Z |
| X-NNLLRAIEAQQHLLQLTVWQIKQLQARILAVERYLKDQ-Z |

The one letter amino acid code is used.

TABLE IIA

| DP178 (SEQ ID:25) AMINO TRUNCATIONS |
|---|
| X-KDQ-Z |
| X-LKDQ-Z |
| X-YLKDQ-Z |
| X-RYLKDQ-Z |
| X-ERYLKDQ-Z |
| X-VERYLKDQ-Z |
| X-AVERYLKDQ-Z |
| X-LAVERYLKDQ-Z |
| X-ILAVERYLKDQ-Z |
| X-RILAVERYLKDQ-Z |
| X-ARILAVERYLKDQ-Z |
| X-QARILAVERYLKDQ-Z |
| X-LQARILAVERYLKDQ-Z |
| X-QLQARILAVERYLKDQ-Z |
| X-KQLQARILAVERYLKDQ-Z |
| X-IKQLQARILAVERYLKDQ-Z |
| X-QIKQLQARILAVERYLKDQ-Z |
| X-WQIKQLQARILAVERYLKDQ-Z |
| X-VWQIKQLQARILAVERYLKDQ-Z |
| X-TVWQIKQLQARILAVERYLKDQ-Z |
| X-LTVWQTKQLQARILAVERYLKDQ-Z |
| X-QLTVWQIKQLQARILAVERYLKDQ-Z |
| X-LQLTVWQIKQLQARILAVERYLKDQ-Z |
| X-LLQLTVWQIKQLQARILAVERYLKDQ-Z |
| X-HLLQLTVWQIKQLQARILAVERYLKDQ-Z |
| X-QHLLQLTVWQIKQLQARILAVERYLKDQ-Z |
| X-QQHLLQLTVWQIKQLQARILAVERYLKDQ-Z |
| X-AQQHLLQLTVWQIKQLQARILAVERYLKDQ-Z |
| X-EAQQHLLQLTVWQIKQLQARILAVERYLKDQ-Z |
| X-IEAQQHLLQLTVWQIKQLQARILAVERYLKDQ-Z |
| X-AIEAQQHLLQLTVWQIKQLQARILAVERYLKDQ-Z |
| X-RAIEAQQHLLQLTVWQIKQLQARILAVERYLKDQ-Z |
| X-LRAIEAQQHLLQLTVWQIKQLQARILAVERYLKDQ-Z |
| X-LLRAIEAQQHLLQLTVWQIKQLQARILAVERYLKDQ-Z |
| X-NLLRAIEAQQHLLQLTVWQIKQLQARILAVERYLKDQ-Z |
| X-NNLLRAIEAQQHLLQLTVWQIKQLQARILAVERYLKDQ-Z |

The one letter amino acid code is used.

The peptides of the invention also include DP107-like peptides. "DP107-like", as used herein, refers, first, to DP107 and DP107 truncations which contain one or more amino acid substitutions, insertions and/or deletions. Second, "DP-107-like" refers to peptide sequences identified or recognized by the ALLMOTI5, 107×178×4 and PLZIP search motifs described herein, having structural and/or amino acid motif similarity to DP107. The DP107-like peptides of the invention may exhibit antifusogenic or antiviral activity, or may exhibit the ability to modulate intracellular processes involving coiled-coil peptides. Further, such DP107-like peptides may possess additional advantageous features, such as, for example, increased bioavailability, and/or stability, or reduced host immune recognition.

HIV-1 and HIV-2 enveloped proteins are structurally distinct, but there exists a striking amino acid conservation within the DP107-corresponding regions of HIV-1 and HIV-2. The amino acid conservation is of a periodic nature, suggesting some conservation of structure and/or function. Therefore, one possible class of amino acid substitutions would include those amino acid changes which are predicted to stabilize the structure of the DP107 peptides of the invention. Utilizing the DP107 and DP107 analog sequences described herein, the skilled artisan can readily complete DP107 consensus sequences and ascertain from these, conserved amino acid residues which would represent preferred amino acid substitutions.

The amino acid substitutions may be of a conserved or non-conserved nature. Conserved amino acid substitutions consist of replacing one or more amino acids of the DP107 (SEQ ID:25) peptide sequence with amino acids of similar charge, size, and/or hydrophobicity characteristics, such as, for example, a glutamic acid (E) to aspartic acid (D) amino acid substitution. Non-conserved substitutions consist of replacing one or more amino acids of the DP107 (SEQ ID:25) peptide sequence with amino acids possessing dissimilar charge, size, and/or hydrophobicity characteristics, such as, for example, a glutamic acid (E) to valine (V) substitution.

Amino acid insertions may consist of single amino acid residues or stretches of residues. The insertions may be made at the carboxy or amino terminal end of the DP107 or DP107 truncated peptides, as well as at a position internal to the peptide. Such insertions will generally range from 2 to 15 amino acids in length. It is contemplated that insertions made at either the carboxy or amino terminus of the peptide of interest may be of a broader size range, with about 2 to about 50 amino acids being preferred. One or more such insertions may be introduced into DP107 (SEQ. ID:25) or DP107 truncations, as long as such insertions result in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures.

Preferred amino or carboxy terminal insertions are peptides ranging from about 2 to about 50 amino acid residues in length, corresponding to gp41 protein regions either amino to or carboxy to the actual DP107 gp41 amino acid sequence, respectively. Thus, a preferred amino terminal or carboxy terminal amino acid insertion would contain gp41 amino acid sequences found immediately amino to or carboxy to the DP107 region of the gp41 protein.

Deletions of DP107 (SEQ ID:25) or DP178 truncations are also within the scope of the invention. Such deletions consist of the removal of one or more amino acids from the DP107 or DP107-like peptide sequence, with the lower limit length of the resulting peptide sequence being 4 to 6 amino acids. Such deletions may involve a single contiguous or greater than one discrete portion of the peptide sequences. One or more such deletions may be introduced into DP107 (SEQ. ID:25) or DP107 truncations, as long as such deletions result in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures.

DP107 and DP107 truncations are more fully described in Applicants' co-pending U.S. patent application Ser. No. 08/374,666, filed Jan. 27, 1995, and which is incorporated herein by reference in its entirety. DP107 analogs are further described, below, in Section 5.3.

5.3. DP107 and DP178 Analogs

Peptides corresponding to analogs of the DP178, DP178 truncations, DP107 and DP107 truncation sequences of the invention, described, above, in Sections 5.1 and 5.2 may be found in other viruses, including, for example, non-HIV-1$_{LAI}$ enveloped viruses, non-enveloped viruses and other non-viral organisms.

The term "analog", as used herein, refers to a peptide which is recognized or identified via the 107×178×4, ALLMOTI5 and/or PLZIP search strategies discussed below. Further, such peptides may exhibit antifusogenic capability, antiviral activity, or the ability to modulate intracellular processes involving coiled-coil structures.

Such DP178 and DP107 analogs may, for example, correspond to peptide sequences present in TM proteins of enveloped viruses and may, additionally correspond to peptide sequences present in non enveloped and non-viral organisms. Such peptides may exhibit antifusogenic activity, antiviral activity, most particularly antiviral activity which is specific to the virus in which their native sequences are found, or may exhibit an ability to modulate intracellular processes involving coiled-coil peptide structures.

DP178 analogs are peptides whose amino acid sequences are comprised of the amino acid sequences of peptide regions of, for example, other (i.e., other than HIV-1$_{LAI}$) viruses that correspond to the gp41 peptide region from which DP178 (SEQ ID:1) was derived. Such viruses may include, but are not limited to, other HIV-1 isolates and HIV-2 isolates. DP178 analogs derived from the corresponding gp41 peptide region of other (i.e., non HIV-1$_{LAI}$) HIV-1 isolates may include, for example, peptide sequences as shown below.

NH$_2$-YT<u>NTIYTL</u>
    LEESQNQQEKNEQELLELDKWASLWNWF—COOH (DP-185; SEQ ID:3)

NH$_2$-YT<u>GIIYNL</u>
    LEESQNQQEKNEQELLELDKWA<u>N</u>LWNWF—COOH (SEQ ID:4);

NH$_2$-YTSL<u>IYSL</u>LE
    KSQIQQEKNEQELLELDKWASLWNWF—COOH (SEQ ID:5).

SEQ ID:3 (DP-185), SEQ ID:4, and SEQ ID:5 are derived from HIV-1$_{SP2}$, HIV-1$_{RF}$, and HIV-1$_{MN}$ isolates, respectively. Underlined amino acid residues refer to those residues that differ from the corresponding position in the DP178 (SEQ ID:1) peptide. One such DP178 analog, DP-185 (SEQ ID:3), is described in the Example presented in Section 6, below, where it is demonstrated that DP-185 (SEQ ID:3) exhibits antiviral activity. The DP178 analogs of the invention may also include truncations, as described above. Further, the analogs of the invention modifications such those described for DP178 analogs in Section 5.1., above. It is preferred that the DP178 analogs of the invention represents peptides whose amino acid sequences correspond to the DP178 region of the gp41 protein, it is also contemplated that the peptides of the invention may, additionally, include amino sequences, ranging from about 2 to about 50 amino acid residues in length, corresponding to gp41 protein regions either amino to or carboxy to the actual DP178 amino acid sequence.

Striking similarities, as shown in FIG. 1, exist within the regions of HIV-1 and HIV-2 isolates which correspond to the DP178 sequence. A DP178 analog derived from the HIV-$2_{NIHZ}$ isolate has the 36 amino acid sequence (reading from amino to carboxy terminus):

NH$_2$-LEANISQSLEQAQIQQEKNMYELQKLNSWDVFTNWL—COOH (SEQ ID:7)

Table III and Table IV show some possible truncations of the HIV-$2_{NIHZ}$ DP178 analog, which may comprise peptides of between 3 and 36 amino acid residues (i.e., peptides ranging in size from a tripeptide to a 36-mer polypeptide). Peptide sequences in these tables are listed from amino (left) to carboxy (right) terminus. "X" may represent an amino group (—NH$_2$) and "Z" may represent a carboxyl (—COOH) group. Alternatively, "X" may represent a hydrophobic group, including but not limited to carbobenzyl, dansyl, or T-butoxycarbonyl; an acetyl group; a 9-fluorenylmethoxycarbonyl (FMOC) group; or a covalently attached macromolecular group, including but not limited to a lipid-fatty acid conjugate, polyethylene glycol, carbohydrate or peptide group. Further, "Z" may represent an amido group; a T-butoxycarbonyl group; or a covalently attached macromolecular group, including but not limited to a lipid-fatty acid conjugate, polyethylene glycol, carbohydrate or peptide group. A preferred "X" or "Z" macromolecular group is a peptide group.

TABLE III

HIV-$2_{NIHZ}$ DP178 analog carboxy truncations.

X-LEA-Z
X-LEAN-Z
X-LEANI-Z
X-LEANIS-Z
X-LEANISQ-Z
X-LEANISQS-Z
X-LEANISQSL-Z
X-LEANISQSLE-Z
X-LEANISQSLEQ-Z
X-LEANISQSLEQA-Z
X-LEANISQSLEQAQ-Z
X-LEANISQSLEQAQI-Z
X-LEANISQSLEQAQIQ-Z
X-LEANISQSLEQAQIQQ-Z
X-LEANISQSLEQAQIQQE-Z
X-LEANISQSLEQAQIQQEK-Z
X-LEANISQSLEQAQIQQEKN-Z
X-LEANISQSLEQAQIQQEKNM-Z
X-LEANISQSLEQAQIQQEKNMY-Z
X-LEANISQSLEQAQIQQEKNMYE-Z

TABLE III-continued

HIV-$2_{NIHZ}$ DP178 analog carboxy truncations.

X-LEANISQSLEQAQIQQEKNMYEL-Z
X-LEANISQSLEQAQIQQEKNMYELQ-Z
X-LEANISQSLEQAQIQQEKNMYELQK-Z
X-LEANISQSLEQAQIQQEKNMYELQKL-Z
X-LEANISQSLEQAQIQQEKNMYELQKLN-Z
X-LEANISQSLEQAQIQQEKNMYELQKLNS-Z
X-LEANISQSLEQAQIQQEKNMYELQKLNSW-Z
X-LEANISQSLEQAQIQQEKNMYELQKLNSWD-Z
X-LEANISQSLEQAQIQQEKNMYELQKLNSWDV-Z
X-LEANISQSLEQAQIQQEKNMYELQKLNSWDVF-Z
X-LEANISQSLEQAQIQQEKNMYELQKLNSWDVFT-Z
X-LEANISQSLEQAQIQQEKNMYELQKLNSWDVFTN-Z
X-LEANISQSLEQAQIQQEKNMYELQKLNSWDVFTNW-Z
X-LEANISQSLEQAQIQQEKNMYELQKLNSWDVFTNWL-Z

The one letter amino acid code is used.

TABLE IV

HIV-$2_{NIHZ}$ DP178 analog amino truncations.

X-NWL-Z
X-TNWL-Z
X-FTNWL-Z
X-VFTNWL-Z
X-DVFTNWL-Z
X-WDVFTNWL-Z
X-SWDVFTNWL-Z
X-NSWDVFTNWL-Z
X-LNSWDVFTNWL-Z
X-KLNSWDVFTNWL-Z
X-QKLNSWDVFTNWL-Z
X-LQKLNSWDVFTNWL-Z
X-ELQKLNSWDVFTNWL-Z
X-YELQKLNSWDVFTNWL-Z
X-MYELQKLNSWDVFTNWL-Z
X-NMYELQKLNSWDVFTNWL-Z
X-KNMYELQKLNSWDVFTNWL-Z
X-EKNMYELQKLNSWDVFTNWL-Z
X-QEKNMYELQKLNSWDVFTNWL-Z
X-QQEKNMYELQKLNSWDVFTNWL-Z
X-IQQEKNMYELQKLNSWDVFTNWL-Z
X-QIQQEKNMYELQKLNSWDVFTNWL-Z
X-AQIQQEKNMYELQKLNSWDVFTNWL-Z
X-QAQIQQEKNMYELQKLNSWDVFTNWL-Z
X-EQAQIQQEKNMYELQKLNSWDVFTNWL-Z
X-LEQAQIQQEKNMYELQKLNSWDVFTNWL-Z
X-SLEQAQIQQEKNMYELQKLNSWDVFTNWL-Z
X-QSLEQAQIQQEKNMYELQKLNSWDVFTNWL-Z
X-SQSLEQAQIQQEKNMYELQKLNSWDVFTNWL-Z
X-ISQSLEQAQIQQEKNMYELQKLNSWDVFTNWL-Z
X-NISQSLEQAQIQQEKNMYELQKLNSWDVFTNWL-Z
X-ANISQSLEQAQIQQEKNMYELQKLNSWDVFTNWL-Z
X-EANISQSLEQAQIQQEKNMYELQKLNSWDVFTNWL-Z
X-LEANISQSLEQAQIQQEKNMYELQKLNSWDVFTNWL-Z

The one letter amino acid code is used.

DP178 and DP107 analogs are recognized or identified, for example, by utilizing one or more of the 107×178×4, ALLMOTIY5 or PLZIP computer-assisted search strategies described and demonstrated, below, in the Examples presented in Sections 9 through 16 and 19 through 25. The search strategy identifies additional peptide regions which are predicted to have structural and/or amino acid sequence features similar to those of DP107 and/or DP178.

The search strategies are described fully, below, in the Example presented in Section 9. While this search strategy is based, in part, on a primary amino acid motif deduced from DP107 and DP178, it is not based solely on searching for primary amino acid sequence homologies, as such protein sequence homologies exist within, but not between major groups of viruses. For example, primary amino acid sequence homology is high within the TM protein of different strains of HIV-1 or within the TM protein of different isolates of simian immunodeficiency virus (SIV). Primary amino acid sequence homology between HIV-1 and SIV, however, is low enough so as not to be useful. It is not possible, therefore, to find peptide regions similar to DP107 or DP178 within other viruses, or within non-viral organisms, whether structurally, or otherwise, based on primary sequence homology, alone.

Further, while it would be potentially useful to identify primary sequence arrangements of amino acids based on, for example, the physical chemical characteristics of different classes of amino acids rather than based on the specific amino acids themselves, such search strategies have, until now, proven inadequate. For example, a computer algorithm designed by Lupas et al. to identify coiled-coil propensities of regions within proteins (Lupas, A., et al., 1991 Science 252:1162–1164) is inadequate for identifying protein regions analogous to DP107 or DP178.

Specifically, analysis of HIV-1 gp160 (containing both gp120 and gp41) using the Lupas algorithm does not identify the coiled-coil region within DP107. It does, however, identify a region within DP178 beginning eight amino acids N-terminal to the start of DP178 and ending eight amino acids from the C-terminus. The DP107 peptide has been shown experimentally to form a stable coiled coil. A search based on the Lupas search algorithm, therefore, would not have identified the DP107 coiled-coil region. Conversely, the Lupas algorithm identified the DP178 region as a potential coiled-coil motif. However, the peptide derived from the DP178 region failed to form a coiled coil in solution.

A possible explanation for the inability of the Lupas search algorithm to accurately identify coiled-coil sequences within the HIV-1 TM, is that the Lupas algorithm is based on the structure of coiled coils from proteins that are not structurally or functionally similar to the TM proteins of viruses, antiviral peptides (e.g., DP107 and DP178) of which are an object of this invention.

The computer search strategy of the invention, as demonstrated in the Examples presented below, in Sections 9 through 16 and 19 through 25, successfully identifies regions of proteins similar to DP107 or DP178. This search strategy was designed to be used with a commercially-available sequence database package, preferably PC/Gene.

A series of search motifs, the 107×178×4, ALLMOTI5 and PLZIP motifs, were designed and engineered to range in stringency from strict to broad, as discussed in this Section and in Section 9, with 107×178×4 being preferred. The sequences identified via such search motifs, such as those listed in Tables V–XIV, below, potentially exhibit antifusogenic, such as antiviral, activity, may additionally be useful in the identification of antifusogenic, such as antiviral, compounds, and are intended to be within the scope of the invention.

Coiled-coiled sequences are thought to consist of heptad amino acid repeats. For ease of description, the amino acid positions within the heptad repeats are sometimes referred to as A through G, with the first position being A, the second B, etc. The motifs used to identify DP107-like and DP178-like sequences herein are designed to specifically search for and identify such heptad repeats. In the descriptions of each of the motifs described, below, amino acids enclosed by brackets, i.e., [], designate the only amino acid residues that are acceptable at the given position, while amino acids enclosed by braces, i.e., {}, designate the only amino acids which are unacceptable at the given heptad position. When a set of bracketed or braced amino acids is followed by a number in parentheses i.e., (), it refers to the number of subsequent amino acid positions for which the designated set of amino acids hold, e.g, a (2) means "for the next two heptad amino acid positions".

The ALLMOTI5 is written as follows:
{CDGHP}—{CFP}(2)—{CDGHP}—{CFP}(3)—
{CDGHP}—{CFP}(2)—{CDGHP}—{CFP}(3)—
{CDGHP}—{CFP}(2)—{CDGHP}—{CFP}(3)—
{CDGHP}—{CFP}(2)—{CDGHP}—{CFP}(3)—
{CDGHP}—{CFP}(2)—{CDGHP}—{CFP}(3)—

Translating this motif, it would read: "at the first (A) position of the heptad, any amino acid residue except C, D, G, H, or P is acceptable, at the next two (B,C) amino acid positions, any amino acid residue except C, F, or P is acceptable, at the fourth heptad position (D), any amino acid residue except C, D, G, H, or P is acceptable, at the next three (E, F, G) amino acid positions, any amino acid residue except C, F, or P is acceptable. This motif is designed to search for five consecutive heptad repeats (thus the repeat of the first line five times), meaning that it searches for 35-mer sized peptides. It may also be designed to search for 28-mers, by only repeating the initial motif four times. With respect to the ALLMOTI5 motif, a 35-mer search is preferred. Those viral (non-bacteriophage) sequences identified via such an ALLMOTI5 motif are listed in Table V in U.S. patent application No. 08/470,896 filed on Jun. 6, 1995 which is incorporated herein by reference in its entirety. These viral sequences potentially exhibit antiviral activity, may be useful in the the identification of antiviral compounds, and are intended to be within the scope of the invention. In those instances wherein a single gene exhibits greater than one sequence recognized by the ALLMOTI5 search motif, the amino acid residue numbers of these sequences are listed under "Area 2", Area 3", etc. This convention is used for each of the Tables listed, below, at the end of this Section.

The 107×178×4 motif is written as follows:
[EFIKLNQSTVWY]—{CFMP}(2)—
[EFIKLNQSTVWY]—{CFMP}(3)—
[EFIKLNQSTVWY]—{CFMP}(2)—
[EFIKLNQSTVWY]—{CFMP}(3)—
[EFIKLNQSTVWY]—{CFMP}(2)—
[EFIKLNQSTVWY]—{CFMP}(3)—
[EFUJKBQSTVWT]—{CFMP}(2)—
[EFIKLNQSTVWY]—{CFMP}(3)—

Translating this motif, it would read: "at the first (A) position of the heptad, only amino acid residue E, F, I, K, L, N, Q, S, T, V, W, or Y is acceptable, at the next two (B,C) amino acid positions, any amino acid residue except C, F, M or P is acceptable, at the fourth position (D), only amino acid residue E, F, I, K, L, N, Q, S, T, V, W, or Y is acceptable, at the next three (E, F, G) amino acid positions, any amino acid residue except C, F, M or P is acceptable. This motif is designed to search for four consecutive heptad repeats (thus the repeat of the first line four times), meaning that it searches for 28-mer sized peptides. It may also be designed to search for 35-mer, by repeating the initial motif five times. With respect to the 107×178×4 motif, a 28-mer search is preferred.

Those viral (non-bacteriophage) sequences identified via such a 107×178×4 motif are listed in Table VI in U.S. patent application No. 08/470,896 filed on Jun. 6, 1995, which is incorporated herein, by reference, in its entirety. Those viral (non-bacteriophage) sequences listed in Table VII of U.S. patent application No. 08/470,896 (incorporated herein by reference in its entirety) are particularly preferred.

The 107×178×4 search motif was also utilized to identify non-viral procaryotic protein sequences, as listed in Table VIII in U.S. patent application No. 08/470,896 filed on Jun. 6, 1995, which is incorporated herein, by reference, in its entirety. Further, this search motif was used to reveal a number of human proteins. The results of this human protein 107×178×4 search is listed in Table IX in U.S. patent application Ser. No. 08/470,896 filed on Jun. 6, 1995, which is incorporated herein, by reference, in its entirety. The sequence listed in Tables VIII and IX, therefore, reveal peptides which may be useful as antifusogenic compounds or in the identification of antifusogenic compounds, and are intended to be within the scope of the invention.

The PLZIP series of motifs are as listed in FIG. 19. These motifs are designed to identify leucine zipper coiled-coil like heptads wherein at least one proline residue is present at some predefined distance N-terminal to the repeat. These PLZIP motifs find regions of proteins with similarities to HIV-1 DP178 generally located just N-terminal to the transmembrane anchor. These motifs may be translated according to the same convention described above. Each line depicted in FIG. 19 represents a single, complete search motif. "X" in these motifs refers to any amino acid residue. In instances wherein a motif contains two numbers within parentheses, this refers to variable number of amino acid residues. For example, X (1, 12) is translated to "the next one to twelve amino acid residues, inclusive, may be any amino acid".

Tables X through XIV in U.S. patent application Ser. No. 08/470,896 filed on Jun. 6, 1995 (which is incorporated herein, by reference, in its entirety), list sequences identified via searches conducted with such PLZIP motifs. Specifically, Table X lists viral sequences identified via PCTLZIP, P1CTLZIP and P2CTLZIP search motifs, Table XI lists viral sequences identified via P3CTLZIP, P4CTLZIP, P5CTLZIP and P6CTLZIP search motifs, Table XII lsts viral sequences identified via P7CTLZIP, P8CTLZIP and P9CTLZIP search motifs, Table XIII lists viral sequences identified via P12LZIPC searches and Table XIV lists viral sequences identified via P23TLZIPC search motifs The viral sequences listed in these tables represent peptides which potentially exhibit antiviral activity, may be useful in the identification of antiviral compounds, and are intended to be within the scope of the invention.

The Examples presented in Sections 17, 18, 26 and 27 below, demonstrate that viral sequences identified via the motif searches described herein identify substantial antiviral characteristics. Specifically, the Example 17 presented in Section 17 describes peptides with anti-respiratory syncytial virus activity, the Example presented in Section 18 describes peptides with anti-parainfluenza virus activity, the Example presented in Section 26 describes peptides with anti-measles virus activity and the Example presented in Section 27 describes peptides with anti-simian immunodeficiency virus activity.

The DP107 and DP178 analogs may, further contain any of the additional groups described for DP178, above, in Section 5.1. For example, these peptides may include any of the additional amino-terminal groups as described above for "X" groups, and may also include any of the carboxy-terminal groups as described, above, for "Z" groups.

Additionally, truncations of the identified DP107 and DP178 peptides are among the peptides of the invention. Further, such DP107 and DP178 analogs and DP107/DP178 analog truncations may exhibit one or more amino acid substitutions, insertion, and/or deletions. The DP178 analog amino acid substitutions, insertions and deletions, are as described, above, for DP178-like peptides in Section 5.1. The DP-107 analog amino acid substitutions, insertions and deletions are also as described, above, for DP107-like peptides in Section 5.2. Representative examples of such DP107/DP178 truncations are provided in Tables XV through XXII of U.S. patent application Ser. No. 08/470,896 filed on Jun. 6, 1995, which is incorporated herein by reference in its entirety.

Other exemplary DP178 and DP107 peptides and DP178-like and DP107-like peptides which are considered part of the present invention include the peptides described in U.S. patent application Ser. No. 09/315,304 filed on May 4, 1999 which is incorporated by reference in its entirety. Such DP178 and DP107 peptides and DP178-like and DP107-like peptides include, e.g., the peptides listed below in Table V.

Other DP178, DP107, DP178-like and DP107-like peptides include peptides described, e.g., in U.S. patent application Ser. No. 08/038,387 filed on Mar. 29, 1993, now U.S. Pat. No. 5,627,023; in U.S. patent application Ser. No. 08/255,208 filed on Jun. 7, 1993, now U.S. Pat. No. 5,464,933; in U.S. patent application Ser. No. 08/255,208 filed on Jun. 7, 1994; in U.S. patent application Ser. No. 08/360,107 filed on Dec. 20, 1994 and in U.S. patent application Ser. No. 08/470,896 filed on Jun. 6, 1995 each of which is incorporated herein by reference in its entirety.

TABLE V

| T No. | Sequence | Seq. ID No. |
|---|---|---|
| 1 | GIKQLQARILAVERYLKDQ | 1 |
| 2 | NNLLRAIEAQQHLLQLTVW | 2 |
| 3 | NEQELLELDKWASLWNWF | 3 |
| 4 | YTSLIHSLIEESQNQQEK | 4 |
| 5 | Ac-VWGIKQLQARILAVERYLKDQQLLGIWG-NH2 | 5 |
| 6 | QHLLQLTVWGIKQLQARILAVERYLKDQ | 6 |
| 7 | LRAIEAQQHLLQLTVWGIKQLQARILAV | 7 |
| 8 | VQQQNNLLARIEAQQHLLQLTVWGIKQL | 8 |
| 9 | RQLLSGIVQQQNNLLRAIEAQQHLLQLT | 9 |
| 10 | MTLTVQARQLLSGIVQQQNNLLRAIEAQ | 10 |
| 12 | VVSLSNGVSVLTSKVLDLKNYIDKQLL | 11 |
| 13 | LLSTNKAVVSLSNGVSVLTSKVLDLKNY | 12 |
| 15 | Ac-VLHLEGEVNKIKSALLSTNKAVVSLSNG-NH2 | 13 |
| 19 | Ac-LLSTNKAVVSLSNGVSVLTSKVLDLKNY-NH2 | 14 |
| 20 | Ac-YTSLIHSLIEESQNQQEKNEQELLELDKWASLWNWF-NH2 | 15 |
| 21 | Ac-NNLLRAIEAQQHLLQLTVWGIKQLQARILAVERYLKDQ-NH2 | 16 |
| 22 | Ac-IELSNIKENKCNGTDAKVKLIKQELDKYKNAVTELQLLMQST-NH2 | 17 |
| 23 | Ac-IELSNIKENKCNGTDAKVKLIKQELDKY-NH2 | 18 |
| 24 | Ac-ENKCNGTDAKVKLIKQELDKYKNAVTEL-NH2 | 19 |
| 25 | Ac-DAKVKLIKQELDKYKNAVTELQLLMQST-NH2 | 20 |
| 26 | Ac-CNGTDAKVKLIKQELDKYKNAVTELQLL-NH2 | 21 |
| 27 | Ac-SNIKENKCNGTDAKVKLIKQELDKYKNAVTELQLL-NH2 | 22 |
| 28 | Ac-ASGVAVSKVLHLEGEVNKIKSALLSTNKAVVSLSNGV-NH2 | 23 |
| 29 | Ac-SGVAVSKVLHLEGEVNKIKSALLSTNKAVVSLSNG-NH2 | 24 |
| 30 | Ac-VLHLEGEVNKIKSALLSTHKAVVSLSNGVSVLTSK-NH2 | 25 |
| 31 | Ac-ARKLQRMKQLEDKVEELLSKNYHYLENEVARLKKLV-NH2 | 26 |
| 32 | Ac-RMKQLEDKVEELLSKNYHYLENEVARLKKLVGER-NH2 | 27 |
| 33 | Ac-VQQQNNLLRAIEAQQHLLQLTVWGIKQL-NH2 | 28 |
| 34 | Ac-LRAIEAQQHLLQLTVWGIKQLQARILAV-NH2 | 29 |
| 35 | Ac-QHLLQLTVWGIKQLQARILAVERYLKDQ-NH2 | 30 |
| 36 | Ac-RQLLSGIVQQQNNLLRAIEAQQHLLQLT-NH2 | 31 |
| 37 | Ac-MTLTVQARQLLSGIVQQQNNLLRAIEAQ-NH2 | 32 |
| 38 | Ac-AKQARSDIEKLKEAIRDTNKAVQSVQSS-NH2 | 33 |
| 39 | Ac-AAVALVEAKQARSDIEKLKEAIRDTNKAVQSVQSS-NH2 | 34 |
| 40 | Ac-AKQARSDIEKLKEAIRDTNKAVQSVQSSIGNLIVA-NH2 | 35 |
| 41 | Ac-GTIALGVATSAQITAAVALVEAKQARSD-NH2 | 36 |
| 42 | Ac-ATSAQITAAVALVEAKQARSDIEKLKEA-NH2 | 37 |
| 43 | Ac-AAVALVEAKQARSDIEKLKEAIRDTNKANH2 | 38 |
| 44 | Ac-IEKLKEAIRDTNKAVQSVQSSIGNLIVA-NH2 | 40 |
| 45 | Ac-IRDTNKAVQSVQSSIGNLIVAIKSVQDY-NH2 | 41 |
| 46 | Ac-AVQSVQSSIGNLIVAIKSVQDYVNKEIV-NH2 | 42 |
| 47 | Ac-QARQLLSGIVQQQNNLLRAIEAQQHLLQLTVWGIKQLARILAVERYLKDQ-NH2 | 43 |
| 48 | Ac-QARQLLSGIVQQQNNLLRAIEAQQHLLQ-NH2 | 44 |
| 49 | Ac-MTWMEMDREINNYTSLIGSLIEESQNQQEKNEQELLELDKWASLWNWF-NH2 | 45 |
| 50 | Ac-WMEWDREINNYTSLIGSLIEESQNQQEKNEQELLE-NH2 | 46 |
| 51 | Ac-INNYTSLIGSLIEESQNQQEKNEQELLE-NH2 | 47 |
| 52 | Ac-INNYTSLIGSLIEESQNQQEKNEQELLELDKWASL-NH2 | 48 |
| 53 | Ac-EWDREINNYTSLIGSLIEESQNQQEKNEQEGGC-NH2 | 49 |
| 54 | Ac-QSRTLLAGIVQQQQQLLDVVKRQQELLR-NH2 | 50 |

| T No. | Sequence | Seq. ID No. |
|---|---|---|
| 55 | Ac-NNDTWQEWERKVDFLEENITALLEEAQIQQEKNMYELQKLNSWD-NH2 | 51 |
| 56 | Ac-WQEWERKVDFLEENITALLEEAQIQQEK-NH2 | 52 |
| 57 | Ac-VDFLEENITALLEEAQIQQEKNMYELQK-NH2 | 53 |
| 58 | Ac-ITALLEEAQIQQEKNMYELQKLNSWDVF-NH2 | 54 |
| 59 | Ac-SSESFTLLEQWNNWKLQLAEQWLEQINEKHYLEDIS-NH2 | 55 |
| 60 | Ac-DKWASLWNWF-NH2 | 56 |
| 61 | Ac-NEQELLELDKWASLWNWF-NH2 | 57 |
| 62 | Ac-EKNEQELLELDKWASLWNWF-NH2 | 58 |
| 63 | Ac-NQQEKNEQELLELDKWASLWNWF-NH2 | 59 |
| 64 | Ac-ESQNQQEKNEQELLELDKWASLWNWF-NH2 | 60 |
| 65 | Ac-LIHSLIEESQNQQEKNEQELLELDKWASLWNWF-NH2 | 61 |
| 66 | Ac-NDQKKLMSNNVQIVRQQSYSIMSIIKEE-NH2 | 62 |
| 67 | Ac-DEFDASISQVNEKINQSLAFIRKSDELL-NH2 | 63 |
| 68 | Ac-VSKGYSALRTGWYTSVITIELSNIKEN-NH2 | 64 |
| 69 | Ac-VVSLSNGVSVLTSKVLDLKNYIDKQLL-NH2 | 65 |
| 70 | Ac-VNKIKSALLSTNKAVVSLSNGVSVLTSK-NH2 | 66 |
| 71 | Ac-PIINFYDPLVFPSDEFDASISQVNEKINQSLAFIR-NH2 | 67 |
| 72 | Ac-NLVYAQLQFTYDTLRGYINRALAQIAEA-NH2 | 68 |
| 73 | Ac-LNQVDLTETLERYQQRLNTYALVSKDASYRS-NH2 | 69 |
| 74 | Ac-ELLVLKKAQLNRHSYLKDSDFLDAALD-NH2 | 70 |
| 75 | Ac-LAEAGEESVTEDTEREDTEEEREDEEE-NH2 | 71 |
| 76 | Ac-ALLAEAGEESVTEDTEREDTEEEREDEEEENEART-NH2 | 72 |
| 77 | Ac-ETERSVDLVAALLAEAGEESVTEDTEREDTEEERE-NH2 | 73 |
| 78 | Ac-EESVTEDTEREDTEEEREDEEEENEART-NH2 | 74 |
| 79 | Ac-VDLVAALLAEAGEESVTEDTEREDTEEE-NH2 | 75 |
| 80 | Ac-NSETERSVDLVAALLAEAGEESVTE-NH2 | 76 |
| 81 | Ac-DISYAQLQFTYDVLKDYINDALRNIMDA-NH2 | 77 |
| 82 | Ac-SNVFSKDEIMREYNSQKQHIRTLSAKVNDN-NH2 | 78 |
| 83 | Biotin-YTSLIHSLIEESQNQQEKNEQELLELDKWASLWNWF-NH2 | 1076 |
| 84 | Dig-YTSLIHSLIEESQNQQEKNEQELLELDKWASLWNWF-NH2 | 1076 |
| 85 | Biotin-NNLLRAIEAQQHLLQLTVWGIKQLQARILAVERYLKDQ-NH2 | 16 |
| 86 | Dig-NNLLRAIEAQQHLLQLTVWGIKQLQARILAVERYLKDQ-NH2 | 16 |
| 87 | Ac-VLHQLNIQLKQYLETQQERLLAGNRIAARQLLQIWKDVA-NH2 | 83 |
| 88 | Ac-LWHEQLLNTAQRAGLQLQLINQALAVREKVLIRYDIQK-NH2 | 84 |
| 89 | Ac-LLDNFESTWEQSKELWEQQEISIQNLHKSALQEYW-NH2 | 85 |
| 90 | Ac-LSNLLQISNNSDEWLEALEIEHEKWKLTQWQSYEQF-NH2 | 86 |
| 91 | Ac-KLEALEGKLEALEGKLEALEGKLEALEGKLEALEGK-NH2 | 87 |
| 92 | Ac-ELRALRGELRALRGELRALRGELRALRGK-NH2 | 88 |
| 93 | Ac-ELKAKELEGEGLAEGEEALKGLLEKAAKLEGLELLK-NH2 | 89 |
| 94 | Ac-WEAAAREAAAREAAAREAAARA-NH2 | 90 |
| 95 | Ac-YTSLIHSLIEESQNQQEKNEQELLELDKWASLWNAF-NH2 | 91 |
| 96 | Ac-YTSLIHSLIEESQNQQEKNEQELLELDKWASLANWF-NH2 | 92 |
| 97 | Ac-YTSLIHSLIEESQNQQEKNQQELLELDKWASLWNWF-NH2 | 93 |
| 98 | Ac-YTSLIHSLIEESQNQQEKNEQELLQLDKWASLWNWF-NH2 | 94 |
| 99 | Ac-YTSLIHSLIEESQNQQEKNQQELLQLDKWASLWNWF-NH2 | 95 |
| 100 | Ac-RMKQLEDKVEELLSSKNYHLENEVARLKKLVGER-NH2 | 96 |
| 101 | Ac-QQLLQLTVWGIKQLQARILAVERYLKNQ-NH2 | 97 |
| 102 | Ac-NEQELLELDKWASLWNWF-NH2 | 98 |
| 103 | Ac-YTSLIQSLIEESQNQQEKNEQELLELDKWASLWNWF-NH2 | 99 |
| 104 | Ac-IINFYDPLVFPSDEFDASISQVNEKINQSLAFIRK-NH2 | 100 |

| T No. | Sequence | Seq. ID No. |
|---|---|---|
| 105 | Ac-INFYDPLVFPSDEFDASISQVNEKINQSLAFIRKS-NH2 | 101 |
| 106 | Ac-NFYDPLVFPSDEFDASISQVNEKINQSLAFIRKSD-NH2 | 102 |
| 107 | Ac-FYDPLVFPSDEFDASISQVNEKINQSLAFIRKSDE-NH2 | 103 |
| 108 | Ac-YDPLVFPSDEFDASISQVNEKINQSLAFIRKSDEL-NH2 | 104 |
| 109 | Ac-DPLVFPSDEFDASISQVNEKINQSLAFIRKSDELL-NH2 | 105 |
| 110 | Ac-PLVFPSDEFDASISQVNEKINQSLAFIRKSDELLH-NH2 | 106 |
| 111 | Ac-LVFPSDEFDASISQVNEKINQSLAFIRKSDELLHN-NH2 | 107 |
| 112 | Ac-VFPSDEFDASISQVNEKINQSLAFIRKSDELLHNV-NH2 | 108 |
| 113 | Ac-FPSDEFDASISQVNEKINQSLAFIRKSDELLHNVN-NH2 | 109 |
| 114 | Ac-PSDEFDASISQVNEKINQSLAFIRKSDELLHNVNA-NH2 | 110 |
| 115 | Ac-SDEFDASISQVNEKINQSLAFIRKSDELLHNVNAG-NH2 | 111 |
| 116 | Ac-DEFDASISQVNEKINQSLAFIRKSDELLHNVNAGK-NH2 | 112 |
| 117 | Ac-EFDASISQVNEKINQSLAFIRKSDELLHNVNAGKS-NH2 | 113 |
| 118 | Ac-FDASISQVNEKINQSLAFIRKSDELLHNVNAGKST-NH2 | 114 |
| 119 | Ac-DASISQVNEKINQSLAFIRKSDELLHNVNAGKSTT-NH2 | 115 |
| 120 | Ac-ASGVAVSKVLHLEGEVNKIKSALLSTNKAVVSLSN-NH2 | 116 |
| 121 | Ac-SGVAVSKVLHLEGEVNKIKSALLSTNKAVVSLSNG-NH2 | 117 |
| 122 | Ac-GVAVSKVLHLEGEVNKIKSALLSTNKAVVSLSNGV-NH2 | 118 |
| 123 | Ac-VAVSKVLHLEGEVNKIKSALLSTNKAVVSLSNGVS-NH2 | 119 |
| 124 | Ac-AVSKVLHLEGEVNKIKSALLSTNKAVVSLSNGVSV-NH2 | 120 |
| 125 | Ac-VSKVLHLEGEVNKIKSALLSTNKAVVSLSNGVSVL-NH2 | 121 |
| 126 | Ac-SKVLHLEGEVNKIKSALLSTNKAVVSLSNGVSVLT-NH2 | 122 |
| 127 | Ac-KVLHLEGEVNKIKSALLSTNKAVVSLSNGVSVLTS-NH2 | 123 |
| 128 | Ac-VLHLEGEVNKIKSALLSTNKAVVSLSNGVSVLTSK-NH2 | 124 |
| 129 | Ac-LHLEGEVNKIKSALLSTNKAVVSLSNGVSVLTSKV-NH2 | 125 |
| 130 | Ac-HLEGEVNKIKSALLSTNKAVVSLSNGVSVLTSKVL-NH2 | 126 |
| 131 | Ac-LEGEVNKIKSALLSTNKAVVSLSNGVSVLTSKVLD-NH2 | 127 |
| 132 | Ac-EGEVNKIKSALLSTNKAVVSLSNGVSVLTSKVLDL-NH2 | 128 |
| 133 | Ac-GEVNKIKSALLSTNKAVVSLSNGVSVLTSKVLDLK-NH2 | 129 |
| 134 | Ac-EVNKIKSALLSTNKAVVSLSNGVSVLTSKVLDLKN-NH2 | 130 |
| 135 | Ac-VNKIKSALLSTNKAVVSLSNGVSVLTSKVLDLKNY-NH2 | 131 |
| 136 | Ac-NKIKSALLSTNKAVVSLSNGVSVLTSKVLDLKNYI-NH2 | 132 |
| 137 | Ac-KIKSALLSTNKAVVSLSNGVSVLTSKVLDLKNYID-NH2 | 133 |
| 138 | Ac-IKSALLSTNKAVVSLSNGVSVLTSKVLDLKNYIDK-NH2 | 134 |
| 139 | Ac-KSALLSTNKAVVSLSNGVSVLTSKVLDLKNYIDKQ-NH2 | 135 |
| 140 | Ac-SALLSTNKAVVSLSNGVSVLTSKVLDLKNYIDKQL-NH2 | 136 |
| 141 | Ac-ALLSTNKAVVSLSNGVSVLTSKVLDLKNYIDKQLL-NH2 | 137 |
| 142 | Ac-YTSVITIELSNIKENKCNGTDAKVKLIKQELDKYK-NH2 | 138 |
| 143 | Ac-TSVITIELSNIKENKCNGTDAKVKLIKQELDKYKN-NH2 | 139 |
| 144 | Ac-SVITIELSNIKENKCNGTDAKVKLIKQELDKYKNA-NH2 | 140 |
| 145 | Ac-VITIELSNIKENKCNGTDAKVKLIKQELDKYKNAV-NH2 | 141 |
| 146 | Ac-ITIELSNIKENKCNGTDAKVKLIKQELDKYKNAVT-NH2 | 142 |
| 147 | Ac-TIELSNIKENKCNGTDAKVKLIKQELDKYKNAVTE-NH2 | 143 |
| 148 | Ac-IELSNIKENKCNGTDAKVKLIKQELDKYKNAVTEL-NH2 | 144 |
| 149 | Ac-ELSNIKENKCNGTDAKVKLIKQELDKYKNAVTELQ-NH2 | 145 |
| 150 | Ac-LSNIKENKCNGTDAKVKLIKQELDKYKNAVTELQL-NH2 | 146 |
| 151 | Ac-SNIKENKCNGTDAKVKLIKQELDKYKNAVTELQLL-NH2 | 147 |
| 152 | Ac-NIKENKCNGTDAKVKLIKQELDKYKNAVTELQLLM-NH2 | 148 |
| 153 | Ac-IKENKCNGTDAKVKLIKQELDKYKNAVTELQLLMQ-NH2 | 149 |
| 154 | Ac-KENKCNGTDAKVKLIKQELDKYKNAVTELQLLMQS-NH2 | 150 |

| T No. | Sequence | Seq. ID No. |
|---|---|---|
| 155 | Ac-ENKCNGTDAKVKLIKQELDKYKNAVTELQLLMQST-NH2 | 151 |
| 156 | Ac-LLDNFESTWEQSKELWELQEISIQNLHKSALQEYWN-NH2 | 152 |
| 157 | Ac-ALGVATSAQITAAVALVEAKQARSDIEKLKEAIRD-NH2 | 153 |
| 158 | Ac-LGVATSAQITAAVALVEAKQARSDIEKLKEAIRDT-NH2 | 154 |
| 159 | Ac-GVATSAQITAAVALVEAKQARSDIEKLKEAIRDTN-NH2 | 155 |
| 160 | Ac-VATSAQITAAVALVEAKQARSDIEKLKEAIRDTNK-NH2 | 156 |
| 161 | Ac-ATSAQITAAVALVEAKQARSDIEKLKEAIRDTNKA-NH2 | 157 |
| 162 | Ac-TSAQITAAVALVEAKQARSDIEKLKEAIRDTNKAV-NH2 | 158 |
| 163 | Ac-SAQITAAVALVEAKQARSDIEKLKEAIRDTNKAVQ-NH2 | 159 |
| 164 | Ac-AQITAAVALVEAKQARSDIEKLKEAIRDTNKAVQS-NH2 | 160 |
| 165 | Ac-QITAAVALVEAKQARSDIEKLKEAIRDTNKAVQSV-NH2 | 161 |
| 166 | Ac-ITAAVALVEAKQARSDIEKLKEAIRDTNKAVQSVQ-NH2 | 162 |
| 167 | Ac-TAAVALVEAKQARSDIEKLKEAIRDTNKAVQSVQS-NH2 | 163 |
| 168 | Ac-AAVALVEAKQARSDIEKLKEAIRDTNKAVQSVQSS-NH2 | 164 |
| 169 | Ac-AVALVEAKQARSDIEKLKEAIRDTNKAVQSVQSSI-NH2 | 165 |
| 170 | Ac-VALVEAKQARSDIEKLKEAIRDTNKAVQSVQSSIG-NH2 | 166 |
| 171 | Ac-ALVEAKQARSDIEKLKEAIRDTNKAVQSVQSSIGN-NH2 | 167 |
| 172 | Ac-LVEAKQARSDIEKLKEAIRDTNKAVQSVQSSIGNL-NH2 | 168 |
| 173 | Ac-VEAKQARSDIEKLKEAIRDTNKAVQSVQSSIGNLI-NH2 | 169 |
| 174 | Ac-EAKQARSDIEKLKEAIRDTNKAVQSVQSSIGNLIV-NH2 | 170 |
| 175 | Ac-KQARSDIEKLKEAIRDTNKAVQSVQSSIGNLIVAI-NH2 | 171 |
| 176 | Ac-QARSDIEKLKEAIRDTNKAVQSVQSSIGNLIVAIK-NH2 | 172 |
| 177 | Ac-ARSDIEKLKEAIRDTNKAVQSVQSSIGNLIVAIKS-NH2 | 174 |
| 178 | Ac-RSDIEKLKEAIRDTNKAVQSVQSSIGNLIVAIKSV-NH2 | 175 |
| 179 | Ac-SDIEKLKEAIRDTNKAVQSVQSSIGNLIVAIKSVQ-NH2 | 176 |
| 180 | Ac-DIEKLKEAIRDTNKAVQSVQSSIGNLIVAIKSVQD-NH2 | 177 |
| 181 | Ac-IEKLKEAIRDTNKAVQSVQSSIGNLIVAIKSVQDY-NH2 | 178 |
| 182 | Ac-EKLKEAIRDTNKAVQSVQSSIGNLIVAIKSVQDYV-NH2 | 179 |
| 183 | Ac-KLKEAIRDTNKAVQSVQSSIGNLIVAIKSVQDYVN-NH2 | 180 |
| 184 | Ac-LKEAIRDTNKAVQSVQSSIGNLIVAIKSVQDYVNK-NH2 | 181 |
| 185 | Ac-KEAIRDTNKAVQSVQSSIGNLIVAIKSVQDYVNKE-NH2 | 182 |
| 186 | Ac-EAIRDTNKAVQSVQSSIGNLIVAIKSVQDYVNKEI-NH2 | 183 |
| 187 | Ac-AIRDTNKAVQSVQSSIGNLIVAIKSVQDYVNKEIV-NH2 | 184 |
| 188 | Ac-IRDTNKAVQSVQSSIGNLIVAIKSVQDYVNKEIV-NH2 | 185 |
| 189 | Ac-YTPNDITLNNSVALDPIDISIELNKAKSDLEESKE-NH2 | 186 |
| 190 | Ac-TPNDITLNNSVALDPIDISIELNKAKSDLEESKEW-NH2 | 187 |
| 191 | Ac-PNDITLNNSVALDPIDISIELNKAKSDLEESKEWI-NH2 | 188 |
| 192 | Ac-NDITLNNSVALDPIDISIELNKAKSDLEESKEWIR-NH2 | 189 |
| 193 | Ac-DITLNNSVALDPIDISIELNKAKSDLEESKEWIRR-NH2 | 190 |
| 194 | Ac-ITLNNSVALDPIDISIELNKAKSDLEESKEWIRRS-NH2 | 191 |
| 195 | Ac-TLNNSVALDPIDISIELNKAKSDLEESKEWIRRSN-NH2 | 192 |
| 196 | Ac-LNNSVALDPIDISIELNKAKSDLEESKEWIRRSNQ-NH2 | 193 |
| 197 | Ac-NNSVALDPIDISIELNKAKSDLEESKEWIRRSNQK-NH2 | 194 |
| 198 | Ac-NSVALDPIDISIELNKAKSDLEESKEWIRRSNQKL-NH2 | 195 |
| 200 | Ac-SVALDPIDISIELNKAKSDLEESKEWIRRSNQKLD-NH2 | 197 |
| 201 | Ac-VALDPIDISIELNKAKSDLEESKEWIRRSNQKLDS-NH2 | 198 |
| 202 | Ac-ALDPIDISIELNKAKSDLEESKEWIRRSNQKLDSI-NH2 | 199 |
| 203 | Ac-LDPIDISIELNKAKSDLEESKEWIRRSNQKLDSIG-NH2 | 200 |
| 204 | Ac-DPIDISIELNKAKSDLEESKEWIRRSNQKLDSIGN-NH2 | 201 |
| 205 | Ac-PIDISIELNKAKSDLEESKEWIRRSNQKLDSIGNW-NH2 | 202 |

| T No. | Sequence | Seq. ID No. |
|---|---|---|
| 206 | Ac-IDISIELNKAKSDLEESKEWIRRSNQKLDSIGNWH-NH2 | 203 |
| 207 | Ac-DISIELNKAKSDLEESKEWIRRSNQKLDSIGNWHQ-NH2 | 204 |
| 208 | Ac-ISIELNKAKSDLEESKEWIRRSNQKLDSIGNWHQS-NH2 | 205 |
| 209 | Ac-SIELNKAKSDLEESKEWIRRSNQKLDSIGNWHQSS-NH2 | 206 |
| 210 | Ac-IELNKAKSDLEESKEWIRRSNQKLDSIGNWHQSST-NH2 | 207 |
| 211 | Ac-ELNKAKSDLEESKEWIRRSNQKLDSIGNWHQSSTT-NH2 | 208 |
| 212 | Ac-ELRALRGELRALRGELRALRGELRALRGELRALRGK-NH2 | 209 |
| 213 | Ac-YTSLIHSLIEESQNQQQKNEQELLELDKWASLWNWF-NH2 | 210 |
| 214 | Ac-YTSLIHSLIEESQNQQEKNEQELLELNKWASLWNWF-NH2 | 211 |
| 215 | Ac-YTSLIHSLIEQSQNQQEKNEQELLELDKWASLWNWF-NH2 | 212 |
| 216 | Ac-YTSLIHSLIQESQNQQEKNEQELLELDKWASLWNWF-NH2 | 213 |
| 217 | Ac-YTSLIHSLIQQSQNQQQKNQQQLLQLNKWASLWNWF-NH2 | 214 |
| 218 | Ac-EQELLELDKWASLWNWF-NH2 | 215 |
| 219 | Ac-QELLELDKWASLWNWF-NH2 | 216 |
| 220 | Ac-ELLELDKWASLWNWF-NH2 | 217 |
| 221 | Ac-LELDKWASLWNWF-NH2 | 218 |
| 222 | Ac-ELDKWASLWNWF-NH2 | 219 |
| 226 | Ac-WASLWNWF-NH2 | 223 |
| 227 | Ac-ASLWNWF-NH2 | 224 |
| 229 | Ac-YTSLIHSLIEESQNQQEKNEQELLELDKWASLANAA-NH2 | 226 |
| 230 | Ac-YTSLIHSLIEESQNQQEKNEQQLLELDKWASLWNWF-NH2 | 227 |
| 231 | Ac-YTSLIQSLIEESQNQQEKNQQELLELDKWASLWNWF-NH2 | 228 |
| 234 | Ac-EAAAREAAAREAAARLELDKWASLWNWF-NH2 | 231 |
| 236 | Ac-PSLRDPISAEISIQALSYALGGDINKVLEKLGYSG-NH2 | 233 |
| 237 | Ac-SLRDPISAEISIQALSYALGGDINKVLEKLGYSGG-NH2 | 234 |
| 238 | Ac-LRDPISAEISIQALSYALGGDINKVLEKLGYSGGD-NH2 | 235 |
| 239 | Ac-RDPISAEISIQALSYALGGDINKVLEKLGYSGGDL-NH2 | 236 |
| 240 | Ac-DPISAEISIQALSYALGGDINKVLEKLGYSGGDLL-NH2 | 237 |
| 241 | Ac-PISAEISIQALSYALGGDINKVLEKLGYSGGDLLG-NH2 | 238 |
| 242 | Ac-ISAEISIQALSYALGGDINKVLEKLGYSGGDLLGI-NH2 | 239 |
| 243 | Ac-SAEISIQALSYALGGDINKVLEKLGYSGGDLLGIL-NH2 | 240 |
| 244 | Ac-AEISIQALSYALGGDINKVLEKLGYSGGDLLGILE-NH2 | 241 |
| 245 | Ac-EISIQALSYALGGDINKVLEKLGYSGGDLLGILES-NH2 | 242 |
| 246 | Ac-ISIQALSYALGGDINKVLEKLGYSGGDLLGILESR-NH2 | 243 |
| 247 | Ac-SIQALSYALGGDINKVLEKLGYSGGDLLGILESRG-NH2 | 244 |
| 248 | Ac-IQALSYALGGDINKVLEKLGYSGGDLLGILESRGI-NH2 | 245 |
| 249 | Ac-QALSYALGGDINKVLEKLGYSGGDLLGILESRGIK-NH2 | 246 |
| 250 | Ac-ALSYALGGDINKVLEKLGYSGGDLLGILESRGIKA-NH2 | 247 |
| 251 | Ac-LSYALGGDINKVLEKLGYSGGDLLGILESRGIKAR-NH2 | 248 |
| 252 | Ac-PDAVYLHRIDLGPPISLERLDVGTNLGNAIAKLED-NH2 | 249 |
| 253 | Ac-DAVYLHRIDLGPPISLERLDVGTNLGNAIAKLEDA-NH2 | 250 |
| 254 | Ac-AVYLHRIDLGPPISLERLDVGTNLGNAIAKLEDAK-NH2 | 251 |
| 255 | Ac-VYLHRIDLGPPISLERLDVGTNLGNAIAKLEDAKE-NH2 | 252 |
| 256 | Ac-YLHRIDLGPPISLERLDVGTNLGNAIAKLEDAKEL-NH2 | 253 |
| 257 | Ac-LHRIDLGPPISLERLDVGTNLGNAIAKLEDAKELL-NH2 | 254 |
| 258 | Ac-HRIDLGPPISLERLDVGTNLGNAIAKLEDAKELLE-NH2 | 255 |
| 259 | Ac-RIDLGPPISLERLDVGTNLGNAIAKLEDAKELLES-NH2 | 256 |
| 260 | Ac-IDLGPPISLERLDVGTNLGNAIAKLEDAKELLESS-NH2 | 257 |
| 261 | Ac-DLGPPISLERLDVGTNLGNAIAKLEDAKELLESSD-NH2 | 258 |
| 262 | Ac-LGPPISLERLDVGTNLGNAIAKLEDAKELLESSDQ-NH2 | 259 |

| T No. | Sequence | Seq. ID No. |
|---|---|---|
| 263 | Ac-GPPISLERLDVGTNLGNAIAKLEDAKELLESSDQI-NH2 | 260 |
| 264 | Ac-PPISLERLDVGTNLGNAIAKLEDAKELLESSDQIL-NH2 | 261 |
| 265 | Ac-PISLERLDVGTNLGNAIAKLEDAKELLESSDQILR-NH2 | 262 |
| 266 | Ac-ISLERLDVGTNLGNAIAKLEDAKELLESSDQIRS-NH2 | 263 |
| 267 | Ac-SLERLDVGTNLGNAIAKLEDAKELLESSDQILRSM-NH2 | 264 |
| 268 | Ac-LERLDVGTNLGNAIAKLEDAKELLESSDQILRSMK-NH2 | 265 |
| 269 | Ac-EWIRRSNQKLDSI-NH2 | 266 |
| 270 | Ac-LELDKWASLANAF-NH2 | 267 |
| 271 | Ac-LELDKWASLFNFF-NH2 | 268 |
| 272 | Ac-LELDKWASLANWF-NH2 | 269 |
| 273 | Ac-LELDKWASLWNAF-NH2 | 270 |
| 274 | Ac-ELGNVNNSISNALDKLEESNSKLDKVNVKLTSTSA-NH2 | 271 |
| 275 | Ac-TELGNVNNSISNALDKLEESNSKLDKVNVKLTSTS-NH2 | 282 |
| 276 | Ac-STELGNVNNSISNALDKLEESNSKLDKVNVKLTST-NH2 | 273 |
| 277 | Ac-ISTELGNVNNSISNALDKLEESNSKLDKVNVKLTS-NH2 | 274 |
| 278 | Ac-DISTELGNVNNSISNALDKLEESNSKLDKVNVKLT-NH2 | 275 |
| 279 | Ac-LDISTELGNVNNSISNALDKLEESNSKLDKVNVKL-NH2 | 276 |
| 280 | Ac-NLDISTELGNVNNSISNALDKLEESNSKLDKVNVK-NH2 | 277 |
| 281 | Ac-GNLDISTELGNVNNSISNALDKLEESNSKLDKVNV-NH2 | 278 |
| 282 | Ac-TGNLDISTELGNVNNSISNALDKLEESNSKLDKVN-NH2 | 279 |
| 283 | Ac-VTGNLDISTELGNVNNSISNALDKLEESNSKLDKV-NH2 | 280 |
| 284 | Ac-IVTGNLDISTELGNVNNSISNALDKLEESNSKLDK-NH2 | 281 |
| 285 | Ac-VIVTGNLDISTELGNVNNSISNALDKLEESNSKLD-NH2 | 282 |
| 286 | Ac-QVIVTGNLDISTELGNVNNSISNALDKLEESNSKL-NH2 | 283 |
| 287 | Ac-SQVIVTGNLDISTELGNVNNSISNALDKLEESNSK-NH2 | 284 |
| 288 | Ac-DSQVIVTGNLDISTELGNVNNSISNALDKLEESNS-NH2 | 285 |
| 289 | Ac-LDSQVIVTGNLDISTELGNVNNSISNALDKLEESN-NH2 | 286 |
| 290 | Ac-ILDSQVIVTGNLDISTELGNVNNSISNALDKLEES-NH2 | 287 |
| 291 | Ac-SILDSQVIVTGNLDISTELGNVNNSISNALDKLEE-NH2 | 288 |
| 292 | Ac-ISILDSQVIVTGNLDISTELGNVNNSISNALDKLE-NH2 | 289 |
| 293 | Ac-NISILDSQVIVTGNLDISTELGNVNNSISNALDKL-NH2 | 290 |
| 294 | Ac-KNISILDSQVIVTGNLDISTELGNVNNSISNALDK-NH2 | 291 |
| 295 | Ac-QKNISILDSQVIVTGNLDISTELGNVNNSISNALD-NH2 | 292 |
| 296 | Ac-YQKNISILDSQVIVTGNLDISTELGNVNNSISNAL-NH2 | 293 |
| 297 | Ac-TYQKNISILDSQVIVTGNLDISTELGNVNNSISNA-NH2 | 294 |
| 298 | Ac-ATYQKNISILDSQVIVTGNLDISTELGNVNNSISN-NH2 | 295 |
| 299 | Ac-DATYQKNISILDSQVIVTGNLDISTELGNVNNSIS-NH2 | 296 |
| 300 | Ac-FDATYQKNISILDSQVIVTGNLDISTELGNVNNSI-NH2 | 297 |
| 301 | Ac-EFDATYQKNISILDSQVIVTGNLDISTELGNVNNS-NH2 | 298 |
| 302 | Ac-GEFDATYQKNISILDSQVIVTGNLDISTELGNVNN-NH2 | 299 |
| 303 | Ac-SGEFDATYQKNISILDSQVIVTGNLDISTELGNVN-NH2 | 300 |
| 304 | Ac-LSGEFDATYQKNISILDSQVIVTGNLDISTELGNV-NH2 | 301 |
| 305 | Ac-RLSGEFDATYQKNISILDSQVIVTGNLDISTELGN-NH2 | 302 |
| 306 | Ac-LRLSGEFDATYQKNISILDSQVIVTGNLDISTELG-NH2 | 303 |
| 307 | Ac-TLRLSGEFDATYQKNISILDSQVIVTGNLDISTEL-NH2 | 304 |
| 308 | Ac-ITLRLSGEFDATYQKNISILDSQVIVTGNLDISTE-NH2 | 305 |
| 309 | Ac-GITLRLSGEFDATYQKNISILDSQVIVTGNLDIST-NH2 | 306 |
| 310 | Ac-TATIEAVHEVTDGLSQLAVAVGKMQQFVNDQFNNT-NH2 | 307 |
| 311 | Ac-ITATIEAVHEVTDGLSQLAVAVGKMQQFVNDQFNN-NH2 | 308 |
| 312 | Ac-SITATIEAVHEVTDGLSQLAVAVGKMQQFVNDQFN-NH2 | 309 |

| T No. | Sequence | Seq. ID No. |
|---|---|---|
| 314 | Ac-KESITATIEAVHEVTDGLSQLAVAVGKMQQFVNDQ-NH2 | 310 |
| 315 | Ac-LKESITATIEAVHEVTDGLSQLAVAVGKMQQFVND-NH2 | 311 |
| 316 | Ac-RLKESITATIEAVHEVTDGLSQLAVAVGKMQQFVN-NH2 | 312 |
| 317 | Ac-LRLKESITATIEAVHEVTDGLSQLAVAVGKMQQFV-NH2 | 313 |
| 318 | Ac-ILRLKESITATIEAVHEVTDGLSQLAVAVGKMQQF-NH2 | 314 |
| 319 | Ac-NILRLKESITATIEAVHEVTDGLSQLAVAVGKMQQ-NH2 | 315 |
| 320 | Ac-ANILRLKESITATIEAVHEVTDGLSQLAVAVGKMQ-NH2 | 316 |
| 321 | Ac-AANILRLKESITATIEAVHEVTDGLSQLAVAVGKM-NH2 | 317 |
| 322 | Ac-HKCDDECMNSVKNGTYDYPKYEEESKLNRNEIKGV-NH2 | 318 |
| 323 | Ac-KCDDECMNSVKNGTYDYPKYEEESKLNRNEIKGVK-NH2 | 319 |
| 324 | Ac-CDDECMNSVKNGTYDYPKYEEESKLNRNEIKGVKL-NH2 | 320 |
| 325 | Ac-DDECMNSVKNGTYDYPKYEEESKLNRNEIKGVKLS-NH2 | 321 |
| 326 | Ac-DECMNSVKNGTYDYPKYEEESKLNRNEIKGVKLSS-NH2 | 322 |
| 327 | Ac-ECMNSVKNGTYDYPKYEEESKLNRNEIKGVKLSSM-NH2 | 323 |
| 328 | Ac-CMNSVKNGTYDYPKYEEESKLNRNEIKGVKLSSMG-NH2 | 324 |
| 329 | Ac-MNSVKNGTYDYPKYEEESKLNRNEIKGVKLSSMGV-NH2 | 325 |
| 330 | Ac-NSVKNGTYDYPKYEEESKLNRNEIKGVKLSSMGVY-NH2 | 326 |
| 331 | Ac-SVKNGTYDYPKYEEESKLNRNEIKGVKLSSMGVYQ-NH2 | 327 |
| 332 | Ac-VKNGTYDYPKYEEESKLNRNEIKGVKLSSMGVYQI-NH2 | 328 |
| 333 | Ac-KNGTYDYPKYEEESKLNRNEIKGVKLSSMGVYQIL-NH2 | 329 |
| 334 | Ac-AFIRKSDELLHNV-NH2 | 330 |
| 335 | Ac-VVLAGAALGVATAAQITAGIALHQSMLNSQAIDNL-NH2 | 331 |
| 336 | Ac-VLAGAALGVATAAQITAGIALHQSMLNSQAIDNLR-NH2 | 332 |
| 337 | Ac-LAGAALGVATAAQITAGIALHQSMLNSQAIDNLRA-NH2 | 333 |
| 338 | Ac-AGAALGVATAAQITAGIALHQSMLNSQAIDNLRAS-NH2 | 334 |
| 339 | Ac-GAALGVATAAQITAGIALHQSMLNSQAIDNLRASL-NH2 | 335 |
| 340 | Ac-AALGVATAAQITAGIALHQSMLNSQAIDNLRASLE-NH2 | 336 |
| 341 | Ac-ALGVATAAQITAGIALHQSMLNSQAIDNLRASLET-NH2 | 337 |
| 342 | Ac-LGVATAAQITAGIALHQSMLNSQAIDNLRASLETT-NH2 | 338 |
| 343 | Ac-GVATAAQITAGIALHQSMLNSQAIDNLRASLETTN-NH2 | 339 |
| 344 | Ac-VATAAQITAGIALHQSMLNSQAIDNLRASLETTNQ-NH2 | 340 |
| 345 | Ac-ATAAQITAGIALHQSMLNSQAIDNLRASLETTNQA-NH2 | 341 |
| 346 | Ac-TAAQITAGIALHQSMLNSQAIDNLRASLETTNQAI-NH2 | 342 |
| 347 | Ac-AAQITAGIALHQSMLNSQAIDNLRASLETTNQAIE-NH2 | 343 |
| 348 | Ac-AQITAGIALHQSMLNSQAIDNLRASLETTNQAIEA-NH2 | 344 |
| 349 | Ac-QITAGIALHQSMLNSQAIDNLRASLETTNQAIEAI-NH2 | 345 |
| 350 | Ac-ITAGIALHQSMLNSQAIDNLRASLETTNQAIEAIR-NH2 | 346 |
| 351 | Ac-TAGIALHQSMLNSQAIDNLRASLETTNQAIEAIRQ-NH2 | 347 |
| 352 | Ac-AGIALHQSMLNSQAIDNLRASLETTNQAIEAIRQA-NH2 | 348 |
| 353 | Ac-GIALHQSMLNSQAIDNLRASLETTNQAIEAIRQAG-NH2 | 349 |
| 354 | Ac-IALHQSMLNSQAIDNLRASLETTNQAIEAIRQAGQ-NH2 | 350 |
| 355 | Ac-ALHQSMLNSQAIDNLRASLETTNQAIEAIRQAGQE-NH2 | 351 |
| 356 | Ac-LHQSMLNSQAIDNLRASLETTNQAIEAIRQAGQEM-NH2 | 352 |
| 357 | Ac-HQSMLNSQAIDNLRASLETTNQAIEAIRQAGQEMI-NH2 | 353 |
| 358 | Ac-QSMLNSQAIDNLRASLETTNQAIEAIRQAGQEMIL-NH2 | 354 |
| 359 | Ac-SMLNSQAIDNLRASLETTNQAIEAIRQAGQEMILA-NH2 | 355 |
| 360 | Ac-MLNSQAIDNLRASLETTNQAIEAIRQAGQEMILAV-NH2 | 356 |
| 361 | Ac-LNSQAIDNLRASLETTNQAIEAIRQAGQEMILAVQ-NH2 | 357 |
| 362 | Ac-NSQAIDNLRASLETTNQAIEAIRQAGQEMILAVQG-NH2 | 358 |
| 363 | Ac-SQAIDNLRASLETTNQAIEAIRQAGQEMILAVQGV-NH2 | 359 |

| T No. | Sequence | Seq. ID No. |
|---|---|---|
| 364 | Ac-QAIDNLRASLETTNQAIEAIRQAGQEMILAVQGVQ-NH2 | 360 |
| 365 | Ac-AIDNLRASLETTNQAIEAIRQAGQEMILAVQGVQD-NH2 | 361 |
| 366 | Ac-IDNLRASLETTNQAIEAIRQAGQEMILAVQGVQDY-NH2 | 362 |
| 367 | Ac-DNLRASLETTNQAIEAIRQAGQEMILAVQGVQDYI-NH2 | 363 |
| 368 | Ac-NLRASLETTNQAIEAIRQAGQEMILAVQGVQDYIN-NH2 | 364 |
| 369 | Ac-LRASLETTNQAIEAIRQAGQEMILAVQGVQDYINN-NH2 | 365 |
| 370 | Ac-RASLETTNQAIEAIRQAGQEMILAVQGVQDYINNE-NH2 | 366 |
| 371 | Ac-YTSVITIELSNIKENKUNGTDAVKLIKQELDKYK-NH2 | 367 |
| 372 | Ac-TSVITIELSNIKENKUNGTDAVKLIKQELDKYKN-NH2 | 368 |
| 373 | Ac-SVITIELSNIKENKUNGTDAVKLIKQELDKYKNA-NH2 | 369 |
| 374 | Ac-SNIKENKUNGTDAKVKLIKQELDKYKNAVTELQLL-NH2 | 370 |
| 375 | Ac-KENKUNGTDAKVKLIKQELDKYKNAVTELQLLMQS-NH2 | 371 |
| 376 | Ac-CLELDKWASLWNWFC-NH2 | 372 |
| 377 | Ac-CLELDKWASLANWFC-NH2 | 373 |
| 378 | Ac-CLELDKWASLFNFFC-NH2 | 374 |
| 379 | Ac-YTSLIHSLIEESQNQQEKNEQELLELDKWASLFNFF-NH2 | 375 |
| 381 | Ac-RMKQLEDKVEELLSKNYHLENELELDKWASLWNWF-NH2 | 376 |
| 382 | Ac-KVEELLSKNYHLENELELDKWASLWNWF-NH2 | 377 |
| 383 | Ac-RMKQLEDKVEELLSKLEWIRRSNQKLDSI-NH2 | 378 |
| 384 | Ac-RMKQLEDKVEELLSKLAFIRKSDELLHNV-NH2 | 379 |
| 385 | Ac-ELEALRGELRALRGELELDKWASLWNWF-NH2 | 380 |
| 386 | Ac-LDPIDISIELNKAKSDLEESKEWIRRSNQKLDSI-NH2 | 381 |
| 387 | Ac-CNEQLSDSFPVEFFQV-NH2 | 382 |
| 388 | Ac-MAEDDPYLGRPEQMFHLDPSL-NH2 | 383 |
| 389 | Ac-EDFSSIADMDFSALLSQISS-NH2 | 384 |
| 390 | Ac-TWQEWERKVDFLEENITALLEEAQIQQEKNMYELQ-NH2 | 385 |
| 391 | Ac-WQEWERKVDFLEENITALLEEAQIQQEKNMYELQK-NH2 | 386 |
| 392 | Ac-QEWERKVDFLEENITALLEEAQIQQEKNMYELQKL-NH2 | 387 |
| 393 | Ac-EWERKVDFLEENITALLEEAQIQQEKNMYELQKLN-NH2 | 388 |
| 394 | Ac-WERKVDFLEENITALLEEAQIQQEKNMYELQKLNS-NH2 | 389 |
| 395 | Ac-ERKVDFLEENITALLEEAQIQQEKNMYELQKLNSW-NH2 | 390 |
| 396 | Ac-RKVDFLEENITALLEEAQIQQEKNMYELQKLNSWD-NH2 | 391 |
| 397 | Ac-KVDFLEENITALLEEAQIQQEKNMYELQKLNSWDV-NH2 | 392 |
| 398 | Ac-VDFLEENITALLEEAQIQQEKNMYELQKLNSWDVF-NH2 | 393 |
| 399 | Ac-DFLEENITALLEEAQIQQEKNMYELQKLNSWDVFG-NH2 | 394 |
| 400 | Ac-FLEENITALLEEAQIQQEKNMYELQKLNSWDVFGN-NH2 | 395 |
| 401 | Ac-LEENITALLEEAQIQQEKNMYELQKLNSWDVFGNW-NH2 | 396 |
| 402 | Ac-LEENITALLEEAQIQQEKNMYELQKLNSWDVFGNWF-NH2 | 397 |
| 403 | Ac-NEQSEEKENELYWAKEQLLDLLFNIFNQTVGAWIMQ-NH2 | 398 |
| 405 | Ac-QQQLLDVVKRQQELLRLTVWGTKNLQTRVTAIEKYLKD-NH2 | 400 |
| 406 | Ac-QQLLDVVKRQQELLRLTVWGTKNLQTRVTAIEKYLKDQ-NH2 | 401 |
| 407 | Ac-QQLLDVVKRQQELLRLTVWGPKNLQTRVTAIEKYLKDQ-NH2 | 402 |
| 408 | Ac-DERKQDKVLVVQQTGTLQLTLIQLEKTAKLQWVRLNRY-NH2 | 403 |
| 409 | Ac-QQQLLDVVKRQQELLRLTVWGTKNLQTRVTAIEKY-NH2 | 404 |
| 410 | Ac-QQLLDVVKRQQELLRLTVWGTKNLQTRVTAIEKYL-NH2 | 405 |
| 411 | Ac-QLLDVVKRQQELLRLTVWGTKNLQTRVTAIEKYLK-NH2 | 406 |
| 412 | Ac-LLDVVKRQQELLRLTVWGTKNLQTRVTAIEKYLKD-NH2 | 407 |
| 413 | Ac-LDVVKRQQELLRLTVWGTKNLQTRVTAIEKYLKDQ-NH2 | 408 |
| 414 | Ac-DVVKRQQELLRLTVWGTKNLQTRVTAIEKYLKDQA-NH2 | 409 |
| 415 | Ac-VVKRQQELLRLTVWGTKNLQTRVTAIEKYLKDQAQ-NH2 | 410 |

| T No. | Sequence | Seq. ID No. |
|---|---|---|
| 416 | Ac-VKRQQELLRLTVWGTKNLQTRVTAIEKYLKDQAQL-NH2 | 411 |
| 417 | Ac-KRQQELLRLTVWGTKNLQTRVTAIEKYLKDQAQLN-NH2 | 412 |
| 418 | Ac-RQQELLRLTVWGTKNLQTRVTAIEKYLKDQAQLNA-NH2 | 413 |
| 419 | Ac-QQELLRLTVWGTKNLQTRVTAIEKYLKDQAQLNAW-NH2 | 414 |
| 420 | Ac-QELLRLTVWGTKNLQTRVTAIEKYLKDQAQLNAWG-NH2 | 415 |
| 421 | Ac-ELLRLTVWGTKNLQTRVTAIEKYLKDQAQLNAWGC-NH2 | 416 |
| 422 | Ac-NNLLRAIEAQQHLLQLTVWGPKQLQARILAVERYLKDQ-NH2 | 417 |
| 423 | Ac-SELEIKRYKNRVASRKCRAKFKQLLQHYREVAAAK-NH2 | 418 |
| 424 | Ac-ELEIKRYKNRVASRKCRAKFKQLLQHYREVAAAKS-NH2 | 419 |
| 425 | Ac-LEIKRYKNRVASRKCRAKFKQLLQHYREVAAAKSS-NH2 | 420 |
| 426 | Ac-EIKRYKNRVASRKCRAKFKQLLQHYREVAAAKSSE-NH2 | 421 |
| 427 | Ac-IKRYKNRVASRKCRAKFKQLLQHYREVAAAKSSEN-NH2 | 422 |
| 428 | Ac-KRYKNRVASRKCRAKFKQLLQHYREVAAAKSSEND-NH2 | 423 |
| 429 | Ac-RYKNRVASRKCRAKFKQLLQHYREVAAAKSSENDR-NH2 | 424 |
| 430 | Ac-YKNRVASRKCRAKFKQLLQHYREVAAAKSSENDRL-NH2 | 425 |
| 431 | Ac-KNRVASRKCRAKFKQLLQHYREVAAAKSSENDRLR-NH2 | 426 |
| 432 | Ac-NRVASRKCRAKFKQLLQHYREVAAAKSSENDRLRL-NH2 | 427 |
| 433 | Ac-RVASRKCRAKFKQLLQHYREVAAAKSSENDRLRLL-NH2 | 428 |
| 434 | Ac-VASRKCRAKFKQLLQHYREVAAAKSSENDRLRLLL-NH2 | 429 |
| 435 | Ac-ASRKCRAKFKQLLQHYREVAAAKSSENDRLRLLLK-NH2 | 430 |
| 436 | Ac-SRKCRAKFKQLLQHYREVAAAKSSENDRLRLLLKQ-NH2 | 431 |
| 437 | Ac-RKCRAKFKQLLQHYREVAAAKSSENDRLRLLLKQM-NH2 | 432 |
| 438 | Ac-KCRAKFKQLLQHYREVAAAKSSENDRLRLLLKQMC-NH2 | 433 |
| 439 | Ac-CRAKFKQLLQHYREVAAAKSSENDRLRLLLKQMCP-NH2 | 434 |
| 440 | Ac-RAKFKQLLQHYREVAAAKSSENDRLRLLLKQMCPS-NH2 | 435 |
| 441 | Ac-AKFKQLLQHYREVAAAKSSENDRLRLLLKQMCPSL-NH2 | 436 |
| 442 | Ac-KFKQLLQHYREVAAAKSSENDRLRLLLKQMCPSLD-NH2 | 437 |
| 443 | Ac-FKQLLQHYREVAAAKSSENDRLRLLLKQMCPSLDV-NH2 | 438 |
| 444 | Ac-KQLLQHYREVAAAKSSENDRLRLLLKQMCPSLDVD-NH2 | 439 |
| 445 | Ac-QLLQHYREVAAAKSSENDRLRLLLKQMCPSLDVDS-NH2 | 440 |
| 446 | Ac-LLQHYREVAAAKSSENDRLRLLLKQMCPSLDVDSI-NH2 | 441 |
| 447 | Ac-LQHYREVAAAKSSENDRLRLLLKQMCPSLDVDSII-NH2 | 442 |
| 448 | Ac-QHYREVAAAKSSENDRLRLLLKQMCPSLDVDSIIP-NH2 | 443 |
| 449 | Ac-HYREVAAAKSSENDRLRLLLKQMCPSLDVDSIIPR-NH2 | 444 |
| 450 | Ac-YREVAAAKSSENDRLRLLLKQMCPSLDVDSIIPRT-NH2 | 445 |
| 451 | Ac-REVAAAKSSENDRLRLLLKQMCPSLDVDSIIPRTP-NH2 | 446 |
| 452 | Ac-EVAAAKSSENDRLRLLLKQMCPSLDVDSIIPRTPD-NH2 | 447 |
| 453 | Ac-VAAAKSSENDRLRLLLKQMCPSLDVDSIIPRTPDV-NH2 | 448 |
| 454 | Ac-AAAKSSENDRLRLLLKQMCPSLDVDSIIPRTPDVL-NH2 | 449 |
| 455 | Ac-AAKSSENDRLRLLLKQMCPSLDVDSIIPRTPDVLH-NH2 | 450 |
| 456 | Ac-AKSSENDRLRLLLKQMCPSLDVDSIIPRTPDVLHE-NH2 | 451 |
| 457 | Ac-KSSENDRLRLLLKQMCPSLDVDSIIPRTPDVLHED-NH2 | 452 |
| 458 | Ac-SSENDRLRLLLKQMCPSLDVDSIIPRTPDVLHEDL-NH2 | 453 |
| 459 | Ac-SENDRLRLLLKQMCPSLDVDSIIPRTPDVLHEDLL-NH2 | 454 |
| 460 | Ac-ENDRLRLLLKQMCPSLDVDSIIPRTPDVLHEDLLN-NH2 | 455 |
| 461 | Ac-NDRLRLLLKQMCPSLDVDSIIPRTPDVLHEDLLNF-NH2 | 456 |
| 534 | Ac-PGYRWMCLRRFIIFLFILLLCLIFLLVLLDYQGML-NH2 | 458 |
| 535 | Ac-GYRWMCLRRFIIFLFILLLCLIFLLVLLDYQGMLP-NH2 | 459 |
| 536 | Ac-YRWMCLRRFIIFLFILLLCLIFLLVLLDYQGMLPV-NH2 | 460 |
| 537 | Ac-RWMCLRRFIIFLFILLLCLIFLLVLLDYQGMLPVC-NH2 | 461 |

| T No. | Sequence | Seq. ID No. |
|---|---|---|
| 538 | Ac-WMCLRRFIIFLFILLLCLIFLLVLLDYQGMLPVCP-NH2 | 462 |
| 539 | Ac-MCLRRFIIFLFILLLCLIFLLVLLDYQGMLPVCPL-NH2 | 463 |
| 540 | Ac-CLRRFIIFLFILLLCLIFLLVLLDYQGMLPVCPLI-NH2 | 464 |
| 541 | Ac-LRRFIIFLFILLLCLIFLLVLLDYQGMLPVCPLIP-NH2 | 465 |
| 542 | Ac-RRFIIFLFILLLCLIFLLVLLDYQGMLPVCPLIPG-NH2 | 466 |
| 543 | Ac-RFIIFLFILLLCLIFLLVLLDYQGMLPVCPLIPGS-NH2 | 467 |
| 544 | Ac-FIIFLFILLLCLIFLLVLLDYQGMLPVCPLIPGSS-NH2 | 468 |
| 545 | Ac-IIFLFILLLCLIFLLVLLDYQGMLPVCPLIPGSST-NH2 | 469 |
| 546 | Ac-IFLFILLLCLIFLLVLLDYQGMLPVCPLIPGSSTT-NH2 | 470 |
| 547 | Ac-FLFILLLCLIFLLVLLDYQGMLPVCPLIPGSSTTS-NH2 | 471 |
| 548 | Ac-LFILLLCLIFLLVLLDYQGMLPVCPLIPGSSTTST-NH2 | 472 |
| 549 | Ac-FILLLCLIFLLVLLDYQGMLPVCPLIPGSSTTSTG-NH2 | 473 |
| 550 | Ac-ILLLCLIFLLVLLDYQGMLPVCPLIPGSSTTSTGP-NH2 | 474 |
| 551 | Ac-LLLCLIFLLVLLDYQGMLPVCPLIPGSSTTSTGPC-NH2 | 475 |
| 552 | Ac-LLCLIFLLVLLDYQGMLPVCPLIPGSSTTSTGPCR-NH2 | 476 |
| 553 | Ac-LCLIFLLVLLDYQGMLPVCPLIPGSSTTSTGPCRT-NH2 | 477 |
| 554 | Ac-CLIFLLVLLDYQGMLPVCPLIPGSSTTSTGPCRTC-NH2 | 478 |
| 555 | Ac-LIFLLVLLDYQGMLPVCPLIPGSSTTSTGPCRTCM-NH2 | 479 |
| 556 | Ac-IFLLVLLDYQGMLPVCPLIPGSSTTSTGPCRTCMT-NH2 | 480 |
| 557 | Ac-FLLVLLDYQGMLPVCPLIPGSSTTSTGPCRTCMTT-NH2 | 481 |
| 558 | Ac-PPLVLQAGFFLLTRILTIPQSLDSWWTSLNFLGGT-NH2 | 482 |
| 559 | Ac-LLVLQAGFFLLTRILTIPQSLDSWWTSLNFLGGTT-NH2 | 483 |
| 560 | Ac-LVLQAGFFLLTRILTIPQSLDSWWTSLNFLGGTTV-NH2 | 484 |
| 561 | Ac-VLQAGFFLLTRILTIPQSLDSWWTSLNFLGGTTVC-NH2 | 485 |
| 562 | Ac-LQAGFFLLTRILTIPQSLDSWWTSLNFLGGTTVCL-NH2 | 486 |
| 563 | Ac-QAGFFLLTRILTIPQSLDSWWTSLNFLGGTTVCLG-NH2 | 487 |
| 564 | Ac-AGFFLLTRILTIPQSLDSWWTSLNFLGGTTVCLGQ-NH2 | 488 |
| 565 | Ac-GFFLLTRILTIPQSLDSWWTSLNFLGGTTVCLGQN-NH2 | 489 |
| 566 | Ac-FFLLTRILTIPQSLDSWWTSLNFLGGTTVCLGQNS-NH2 | 490 |
| 567 | Ac-FLLTRILTIPQSLDSWWTSLNFLGGTTVCLGQNSQ-NH2 | 491 |
| 568 | Ac-LLTRILTIPQSLDSWWTSLNFLGGTTVCLGQNSQS-NH2 | 492 |
| 569 | Ac-LTRILTIPQSLDSWWTSLNFLGGTTVCLGQNSQSP-NH2 | 493 |
| 570 | Ac-FWNWLSAWKDLELKSLLEEVKDELQKMR-NH2 | 494 |
| 571 | Ac-NNLLRAIEAQQHLLQLTVW-NH2 | 495 |
| 572 | Ac-CGGNNLLRAIEAQQHLLQLTVWGIKQLQARILAVERYLKDQ-NH2 | 496 |
| 573 | Ac-YTSLIHSLIEESQNQQEKNEQELLELDKWASLWNWF-NH2 | 497 |
| 574 | C13H27CO-YTSLIHSLIEESQNQQEKNEQELLELDKWASLWNWF-NH2 | 498 |
| 575 | Ac-AVSKGYLSALRTGWYTSVITIELSNIKENKUNGTDA-NH2 | 499 |
| 576 | Ac-SISNIETVIEFQQKNNRLLEITREFSVNAGVTTPVS-NH2 | 500 |
| 577 | Ac-DQQIKQYKRLLDRLIIPLYDGLRQKDVIVSNQESN-NH2 | 501 |
| 578 | Ac-YSELTNIFGDNIGSLQEKGIKLQGIASLYRTNITEI-NH2 | 502 |
| 579 | Ac-TSITLQVRLPLLTRLLNTQIYRVDSISYNIQNREWY-NH2 | 503 |
| 580 | Ac-VEIAEYRRLLRTVLEPIRDALNAMTQNIRPVQSVA-NH2 | 504 |
| 581 | Ac-SYFIVLSIAYPTLSEIKGVIVHRLEGVSYNIGSQEW-NH2 | 505 |
| 582 | Ac-LKEAIRDTNKAVQSVQSSIGNLIVAIKS-NH2 | 506 |
| 583 | NNLLRAIEAQQHLLQLTVWGIKQLQARILAVERYLKDQ-NH2 | 507 |
| 583 | NNLLRAIEAQQHLLQLTVWGIKQLQARILAVERYLKDQ-NH2 | 507 |
| 584 | QKQEPIDKELYPLTSL | 508 |
| 585 | YPKFVKQNTLKLAT | 509 |
| 586 | QYIKANQKFIGITE | 510 |

| T No. | Sequence | Seq. ID No. |
|---|---|---|
| 587 | NGQIGNDPNRDILY | 511 |
| 588 | AC-RPDVY-OH | 512 |
| 589 | CLELDKWASLWNWFC-(cyclic) | 513 |
| 590 | CLELDKWASLANWFC-(cyclic) | 514 |
| 591 | CLELDKWASLANFFC-(cyclic) | 515 |
| 594 | Ac-NNLLRAIEAQQQHLLQLTVWGIKQLQARILAVERYLKDQ-NH2 | 516 |
| 595 | Ac-CGGYTSLIHSLIEESQNQQEKNEQELLELDKWASLWNNWF-NH2 | 517 |
| 596 | Ac-PLLVLQAGFFLLTRILTIPQSLDSWWTSLNFLGGT-NH2 | 518 |
| 597 | Ac-LLVLQAGFFLLTRILTIPQSLDSWWTSLNFLGGTT-NH2 | 519 |
| 598 | Ac-LVLQAGFFLLTRILTIPQSLDSWWTSLNFLGGTTV-NH2 | 520 |
| 599 | Ac-VLQAGFFLLTRILTIPQSLDSWWTSLNFLGGTTVC-NH2 | 521 |
| 600 | Ac-LQAGFFLLTRILTIPQSLDSWWTSLNFLGGTTVCL-NH2 | 522 |
| 601 | Ac-QAGFFLLTRILTIPQSLDSWWTSLNFLGGTTVCLG-NH2 | 523 |
| 602 | Ac-AGFFLLTRILTIPQSLDSWWTSLNFLGGTTVCLGQ-NH2 | 524 |
| 603 | Ac-GFFLLTRILTIPQSLDSWWTSLNFLGGTTVCLGQN-NH2 | 525 |
| 604 | Ac-FFLLTRILTIPQSLDSWWTSLNFLGGTTVCLGQNS-NH2 | 526 |
| 605 | Ac-FLLTRILTIPQSLDSWWTSLNFLGGTTVCLGQNSQ-NH2 | 527 |
| 606 | Ac-LLTRILTIPQSLDSWWTSLNFLGGTTVCLGQNSQS-NH2 | 528 |
| 607 | Ac-LTRILTIPQSLDSWWTSLNFLGGTTVCLGQNSQSP-NH2 | 529 |
| 608 | Ac-LELDKWASLWNWA-NH2 | 530 |
| 609 | Ac-LELDKWASAWNWF-NH2 | 531 |
| 610 | Ac-LELDKAASLWNWF-NH2 | 532 |
| 611 | Ac-LKLDKWASLWNWF-NH2 | 533 |
| 612 | Ac-LELKKWASLWNWF-NH2 | 534 |
| 613 | Ac-DELLHNVNAGKST-NH2 | 535 |
| 614 | Ac-KSDELLHNVNAGKST-NH2 | 536 |
| 615 | Ac-IRKSDELLHNVNAGKST-NH2 | 537 |
| 616 | Ac-AFIRKSDELLHNVNAGKST-NH2 | 538 |
| 617 | Ac-FDASISQVNEKINQSLAFI-NH2 | 539 |
| 618 | Ac-YAADKESTQKAFDGITNKVNSVIEKMNTQFEAVGKE-NH2 | 540 |
| 619 | Ac-SVIEKMNTQFEAVGKEFGNLERRLENLNKRMEDGFL-NH2 | 541 |
| 620 | Ac-VWTYNAELLVLMENERTLDFHDSNVKNLYDKVRMQL-NH2 | 542 |
| 621 | Ac-EWDREINNYTSLIHSLIEESQNQQEKNEQEGGC-NH2 | 543 |
| 622 | Ac-INNYTSLIHSLIEESQNQQEKNEQELLELDKWASL-NH2 | 544 |
| 623 | Ac-INNYTSLIHSLIEESQNQQEKNEQELLE-NH2 | 545 |
| 624 | Ac-WMEWDREINNYTSLIHSLIEESQNQQEKNEQELLE-NH2 | 546 |
| 625 | Ac-MTWMEWDREINNYTSLIHSLIEESQNQQEKNEQELLELDKWASLWNWF-NH2 | 547 |
| 626 | Ac-IDISIELNKAKSDLEESKEWIKKSNQKLDSIGNWH-NH2 | 548 |
| 627 | Ac-NQQEKNEQELLELDKWASLWNWFNITNWLWYIKIFI-NH2 | 549 |
| 627 | Ac-NQQEKNEQELLELDKWASLWNWFNITNWLWYIKIFI-NH2 | 549 |
| 628 | Ac-QNQQEKNEQELLELDKWASLWNWFNITNWLWYIKIF-NH2 | 550 |
| 629 | Ac-SQNQQEKNEQELLELDKWASLWNWFNITNWLWYIKI-NH2 | 551 |
| 630 | Ac-ESQNQQEKNEQELLELDKWASLWNWFNITNWLWYIK-NH2 | 552 |
| 631 | Ac-EESQNQQEKNEQELLELDKWASLWNWFNITNWLWYI-NH2 | 553 |
| 632 | Ac-IEESQNQQEKNEQELLELDKWASLWNWFNITNWLWY-NH2 | 554 |
| 633 | Ac-LIEESQNQQEKNEQELLELDKWASLWNWFNITNWLW-NH2 | 555 |
| 634 | Ac-SLIEESQNQQEKNEQELLELDKWASLWNWFNITNWL-NH2 | 556 |
| 635 | Ac-HSLIEESQNQQEKNEQELLELDKWASLWNWFNITNW-NH2 | 557 |
| 636 | Ac-IHSLIEESQNQQEKNEQELLELDKWASLWNWFNITN-NH2 | 558 |
| 637 | Ac-LIHSLIEESQNQQEKNEQELLELDKWASLWNWFNIT-NH2 | 559 |

| T No. | Sequence | Seq. ID No. |
|---|---|---|
| 638 | Ac-SLIHSLIEESQNQQEKNEQELLELDKWASLWNWFNI-NH2 | 560 |
| 639 | Ac-TSLIHSLIEESQNQQEKNEQELLELDKWASLWNWFN-NH2 | 561 |
| 640 | Ac-NYTSLIHSLIEESQNQQEKNEQELLELDKWASLWNW-NH2 | 562 |
| 641 | Ac-NNYTSLIHSLIEESQNQQEKNEQELLELDKWASLWN-NH2 | 563 |
| 642 | Ac-INNYTSLIHSLIEESQNQQEKNEQELLELDKWASLW-NH2 | 564 |
| 643 | Ac-EINNYTSLIHSLIEESQNQQEKNEQELLELDKWASL-NH2 | 565 |
| 644 | Ac-REINNYTSLIHSLIEESQNQQEKNEQELLELDKWAS-NH2 | 566 |
| 645 | Ac-DREINNYTSLIHSLIEESQNQQEKNEQELLELDKWA-NH2 | 567 |
| 646 | Ac-WDREINNYTSLIHSLIEESQNQQEKNEQELLELDKW-NH2 | 568 |
| 647 | Ac-EWDREINNYTSLIHSLIEESQNQQEKNEQELLELDK-NH2 | 569 |
| 648 | Ac-MEWDREINNYTSLIHSLIEESQNQQEKNEQELLELD-NH | 570 |
| 649 | Ac-WMEWDREINNYTSLIHSLIEESQNQQEKNEQELLEL-NH2 | 572 |
| 650 | Ac-TWMEWDREINNYTSLIHSLIEESQNQQEKNEQELLE-NH2 | 573 |
| 651 | Ac-MTWMEWDREINNYTSLIHSLIEESQNQQEKNEQELL-NH2 | 574 |
| 652 | Ac-NMTWMEWDREINNYTSLIHSLIEESQNQQEKNEQEL-NH2 | 575 |
| 653 | Ac-NNMTWMEWDREINNYTSLIHSLIEESQNQQEKNEQE-NH2 | 576 |
| 654 | Ac-WNNMTWMEWDREINNYTSLIHSLIEESQNQQEKNEQ-NH2 | 577 |
| 655 | Ac-IWNNMTWMEWDREINNYTSLIHSLIEESQNQQEKNE-NH2 | 578 |
| 656 | Ac-QIWNNMTWMEWDREINNYTSLIHSLIEESQNQQEKN-NH2 | 579 |
| 657 | Ac-EQIWNNMTWMEWDREINNYTSLIHSLIEESQNQQEK-NH2 | 580 |
| 658 | Ac-LEQIWNNMTWMEWDREINNYTSLIHSLIEESQNQQE-NH2 | 581 |
| 659 | Ac-SLEQIWNNMTWMEWDREINNYTSLIHSLIEESQNQQ-NH2 | 582 |
| 660 | Ac-KSLEQIWNNMTWMEWDREINNYTSLIHSLIEESQNQ-NH2 | 583 |
| 661 | Ac-NKSLEQIWNNMTWMEWDREINNYTSLIHSLIEESQN-NH2 | 584 |
| 662 | Ac-SLAFIRKSDELLHNVNAGKST-NH2 | 585 |
| 663 | Ac-FDASISQVNEKINQSLAFIRK-NH2 | 586 |
| 664 | Ac-YTSLIHSLIEESQQQQEKQEQELLELDKWASLWNWF-NH2 | 587 |
| 665 | Ac-FDASISQVNEKINQSLAFIRKSDELLHNVNAGK-NH2 | 588 |
| 666 | Ac-FDASISQVNEKINQSLAFIRKSDELLHNVNA-NH2 | 589 |
| 667 | Ac-FDASISQVNEKINQSLAFIRKSDELLHNV-NH2 | 590 |
| 668 | Ac-FDASISQVNEKINQSLAFIRKSDELLH-NH2 | 591 |
| 669 | Ac-FDASISQVNEKINQSLAFIRKSDEL-NH2 | 592 |
| 670 | Ac-FDASISQVNEKINQSLAFIRKSD-NH2 | 593 |
| 671 | Ac-ASISQVNEKINQSLAFIRKSDELLHNVNAGKST-NH2 | 594 |
| 672 | Ac-ISQVNEKINQSLAFIRKSDELLHNVNAGKST-NH2 | 595 |
| 673 | Ac-QVNEKINQSLAFIRKSDELLHNVNAGKST-NH2 | 596 |
| 674 | Ac-NEKINQSLAFIRKSDELLHNVNAGKST-NH2 | 597 |
| 675 | Ac-KINQSLAFIRKSDELLHNVNAGKST-NH2 | 598 |
| 676 | Ac-NQSLAFIRKSDELLHNVNAGKST-NH2 | 599 |
| 677 | Ac-FWNWLSAWKDLELYPGSLELDKWASLWNWF-NH2 | 600 |
| 678 | Ac-CGGNNLLRAIEAQQHLLQLTVWGIKQLQARILAVERYLKDQ-NH2 | 601 |
| 679 | Ac-CGGYTSLIHSLIEESQNQQEKNEQELLELDKWASLWNWF-NH2 | 602 |
| 680 | YTSLIHSLIEESQNQQEKNEQELLELDKWASLWNWF | 603 |
| 681 | NNLLRAIEAQQHLLQLTVWGIKQLQARILAVERYLKDQ | 604 |
| 682 | Ac-EKNMYELQKLNSWDVFTNWLDFTSWVRYIQYIQYGV-NH2 | 605 |
| 683 | Ac-QEKNMYELQKLNSWDVFTNWLDFTSWVRYIQYIQYG-NH2 | 606 |
| 684 | Ac-QQEKNMYELQKLNSWDVFTNWLDFTSWVRYIQYIQY-NH2 | 607 |
| 685 | Ac-IQQEKNMYELQKLNSWDVFTNWLDFTSWVRYIQYIQ-NH2 | 608 |
| 686 | Ac-QIQQEKNMYELQKLNSWDVFTNWLDFTSWVRYIQYI-NH2 | 609 |
| 687 | Ac-AQIQQEKNMYELQKLNSWDVFTNWLDFTSWVRYIQY-NH2 | 610 |

| T No. | Sequence | Seq. ID No. |
|---|---|---|
| 688 | Ac-QAQIQQEKNMYELQKLNSWDVFTNWLDFTSWVRYIQ-NH2 | 611 |
| 689 | Ac-EQAQIQQEKNMYELQKLNSWDVFTNWLDFTSWVRYI-NH2 | 612 |
| 690 | Ac-LEQAQIQQEKNMYELQKLNSWDVFTNWLDFTSWVRY-NH2 | 613 |
| 691 | Ac-SLEQAQIQQEKNMYELQKLNSWDVFTNWLDFTSWVR-NH2 | 614 |
| 692 | Ac-QSLEQAQIQQEKNMYELQKLNSWDVFTNWLDFTSWV-NH2 | 615 |
| 693 | Ac-SQSLEQAQIQQEKNMYELQKLNSWDVFTNWLDFTSW-NH2 | 616 |
| 694 | Ac-ISQSLEQAQIQQEKNMYELQKLNSWDVFTNWLDFTS-NH2 | 617 |
| 695 | Ac-NISQSLEQAQIQQEKNMYELQKLNSWDVFTNWLDFT-NH2 | 618 |
| 696 | Ac-ANISQSLEQAQIQQEKNMYELQKLNSWDVFTNWLDF-NH2 | 619 |
| 697 | Ac-EANISQSLEQAQIQQEKNMYELQKLNSWDVFTNWLD-NH2 | 620 |
| 699 | Ac-YLEANISQSLEQAQIQQEKNMYELQKLNSWDVFTNW-NH2 | 621 |
| 700 | Ac-YTSLIHSLIEESQNQQEKNEQEL-NH2 | 622 |
| 701 | Ac-YTSLIHSLIEESQNLQEKNEQELLELDKWASLWNWF-NH2 | 623 |
| 702 | Ac-YTSLIHSLIEESQNQQEKLEQELLELDKWASLWNWF-NH2 | 624 |
| 703 | Ac-YTSLIHSLIEESQNQQEKNEQELLEFDKWASLWNWF-NH2 | 625 |
| 704 | Ac-YTSLIHSLIEESQNQQEKNEQELLELDKPASLWNWF-NH2 | 626 |
| 705 | Ac-YTSLIHSLIEESQNQQEKNEQELLELDKWASPWNWF-NH2 | 627 |
| 706 | Ac-YTSLIHSLIEESQNQQEKNEQELLELDKWASLWNSF-NH2 | 628 |
| 707 | Biotin NH(CH2)4CO-YTSLIHSLIEESQNQQEKNEQELLELDKWASLWNWF-NH2 | 629 |
| 708 | Biotin NH(CH2)6CO-YTSLIHSLIEESQNQQEKNEQELLELDKWASLWNWF-NH2 | 630 |
| 709 | FMOC-YTSLIHSLIEESQNQQEKNEQELLELDKWASLWNWF | 92 |
| 710 | FMOC-NNLLRAIEAQQHLLQLTVWGIKQLQARILAVERYLKDQ | 16 |
| 711 | Ac-EWDREINNYTSLIHSLIEESQNQQEKNEQE-NH2 | 634 |
| 712 | Ac-LIEESQNQQEKNEQELLELDKWASLWNWF-NH2 | 635 |
| 713 | Ac-FWNWLSAWKDLELGGPGSGPGGLELDKWASLWNWF-NH2 | 636 |
| 714 | Ac-LIHSLIEESQNQQEKNEQELLELDKWASL-NH2 | 637 |
| 715 | Ac-TSLIHSLIEESQNQQEKNEQELLELDKWASLWNWF-NH2 | 638 |
| 716 | Ac-LIHSLIEESQNQQEKNEQELLELDKWASLWNWF-NH2 | 639 |
| 718 | FMOC-GGGGGYTSLIHSLIEESQNQQEKNEQELLELDKWASLWNWF-NH2 | 640 |
| 719 | Ac-HSLIEESQNQQEKNEQELLELDKWASLWNWF-NH2 | 641 |
| 720 | Ac-YTSLIYSLIEESQNQQEKNEQELLELDKWASLWNWF-NH2 | 642 |
| 721 | Ac-YTSLIHSLIEKSQNQQEKNEQELLELDKWASLWNWF-NH2 | 643 |
| 722 | Ac-YTSLIHSSIEESQNQQEKNEQELLELDKWASLWNWF-NH2 | 644 |
| 723 | Ac-LEANISQLLEQAQIQQEKNMYELQKLNSWDVFTNWL-NH2 | 645 |
| 724 | Ac-SLEECDSELEIKRYKNRVASRKCRAKFKQLLQHYR-NH2 | 646 |
| 725 | Ac-LEECDSELEIKRYKNRVASRKCRAKFKQLLQHYRE-NH2 | 647 |
| 726 | Ac-EECDSELEIKRYKNRVASRKCRAKFKQLLQHYREV-NH2 | 648 |
| 727 | Ac-ECDSELEIKRYKNRVASRKCRAKFKQLLQHYREVA-NH2 | 649 |
| 728 | Ac-CDSELEIKRYKNRVASRKCRAKFKQLLQHYREVAA-NH2 | 650 |
| 729 | Ac-DSELEIKRYKNRVASRKCRAKFKQLLQHYREVAAA-NH2 | 651 |
| 730 | Desaminotyrosine-FDASISQVNEKINQSLAFIRKSDELLHNVNAGKST-NH2 | 652 |
| 731 | WASLWNW-NH2 | 653 |
| 732 | Ac-EAQQHLLQLTVWGIKQLQARILAVERYLKDQQLLGIWG-NH2 | 654 |
| 733 | Ac-IEAQQHLLQLTVWGIKQLQARILAVERYLKDQQLLGIW-NH2 | 655 |
| 734 | Ac-AIEAQQHLLQLTVWGIKQLQARILAVERYLKDQQLLGI-NH2 | 656 |
| 735 | Ac-RAIEAQQHLLQLTVWGIKQLQARILAVERYLKDQQLLG-NH2 | 657 |
| 736 | Ac-LRAIEAQQHLLQLTVWGIKQLQARILAVERYLKDQQLL-NH2 | 658 |
| 737 | Ac-LLRAIEAQQHLLQLTVWGIKQLQARILAVERYLKDQQL-NH2 | 659 |
| 738 | Ac-NLLRAIEAQQHLLQLTVWGIKQLQARILAVERYLKDQQ-NH2 | 660 |
| 739 | Ac-QNNLLRAIEAQQHLLQLTVWGIKQLQARILAVERYLKD-NH2 | 661 |

| T No. | Sequence | Seq. ID No. |
|---|---|---|
| 740 | Ac-QQNNLLRAIEAQQHLLQLTVWGIKQLQARILAVERYLK-NH2 | 662 |
| 741 | Ac-QQQNNLLRAIEAQQHLLQLTVWGIKQLQARILAVERYL-NH2 | 663 |
| 742 | Ac-VQQQNNLLRAIEAQQHLLQLTVWGIKQLQARILAVERY-NH2 | 664 |
| 743 | Ac-IVQQQNNLLRAIEAQQHLLQLTVWGIKQLQARILAVER-NH2 | 665 |
| 744 | Ac-GIVQQQNNLLRAIEAQQHLLQLTVWGIKQLQARILAVE-NH2 | 666 |
| 745 | Ac-SGIVQQQNNLLRAIEAQQHLLQLTVWGIKQLQARILAV-NH2 | 667 |
| 758 | Ac-RSMTLTVQARQLLSGIVQQQNNLLRAIEAQQHLLQLTV-NH2 | 668 |
| 760 | Ac-GARSMTLTVQARQLLSGIVQQQNNLLRAIEAQQHLLQL-NH2 | 669 |
| 764 | Ac-GSTMGARSMTLTVQARQLLSGIVQQQNNLLRAIEAQQH-NH2 | 670 |
| 765 | Ac-GSTMGARSMTLTVQARQLLSGIVQQQNNLLRAIEAQQH-NH2 | 671 |
| 766 | Ac-EGSTMGARSMTLTVQARQLLSGIVQQQNNLLRAIEAQQ-NH2 | 672 |
| 767 | Ac-RAKFKQLLQHYREVAAAKSSENDRLRLL-NH2 | 673 |
| 768 | Ac-AKFKQLLQHYREVAAAKSSENDRLRLLL-NH2 | 674 |
| 769 | Ac-KFKQLLQHYREVAAAKSSENDRLRLLLK-NH2 | 675 |
| 770 | Ac-FKQLLQHYREVAAAKSSENDRLRLLLKQ-NH2 | 676 |
| 771 | Ac-RAKFKQELQHYREVAAAKSSENDRLRLLLKQMCPS-NH2 | 677 |
| 772 | DKWASLWNWF-NH2 | 678 |
| 773 | Biotin-FDASISQVNEKINQSLAFIRKSDELLHNVAGKST-NH2 | 679 |
| 774 | Ac-YDASISQVNEKINQSLAFIRKSDELLHNVAGKST-NH2 | 680 |
| 775 | Ac-YDASISQVNEKINQSLAYIRKSDELLHNVAGKST-NH2 | 681 |
| 776 | Ac-FDASISQVNEKINQSLAYIRKSDELLHNVAGKST-NH2 | 682 |
| 777 | Ac-FDASISQVQEKIQQSLAFIRKSDELLHQVQAGKST-NH2 | 683 |
| 778 | Ac-FDASISQVNEKINQALAFIRKADELLHNVAGKST-NH2 | 684 |
| 779 | Ac-FDASISQVNEKINQALAFIRKSDELLHNVAGKST-NH2 | 685 |
| 780 | Ac-FDASISQVNEKINQSLAFIRKADELLHNVAGKST-NH2 | 686 |
| 781 | Ac-YDASISQVQEEIQQALAFIRKADELLEQVQAGKST-NH2 | 687 |
| 782 | Ac-FDASISQVNEKINQSLAFIRKSDELLENVAGKST-NH2 | 688 |
| 783 | Ac-FDASISQVNEEINQSLAFIRKSDELLHNVAGKST-NH2 | 689 |
| 784 | Ac-VFPSDEFDASISQVNEKINQSLAFIRKSDELLENV-NH2 | 690 |
| 785 | Ac-VFPSDEFDASISQVNEEINQSLAFIRKSDELLENV-NH2 | 691 |
| 786 | Ac-VYPSDEYDASISQVNEEINQALAYIRKADELLENV-NH2 | 692 |
| 787 | Ac-VFPSDEFDASISQVNEEINQSLAFIRKSDELLHNV-NH2 | 693 |
| 788 | Ac-SNKSLEQIWNNMTWMEWDREINNYTSLIHSLIEESQ-NH2 | 694 |
| 789 | Ac-WSNKSLEQIWNNMTWMEWDREINNYTSLIHSLIEES-NH2 | 695 |
| 790 | Ac-SWSNKSLEQIWNNMTWMEWDREINNYTSLIHSLIEE-NH2 | 696 |
| 791 | Ac-ASWSNKSLEQIWNNMTWMEWDREINNYTSLIHSLIE-NH2 | 697 |
| 792 | Ac-NASWSNKSLEQIWNNMTWMEWDREINNYTSLIHSLI-NH2 | 698 |
| 793 | Ac-WNASWSNKSLEQIWNNMTWMEWDREINNYTSLIHSL-NH2 | 699 |
| 793 | Ac-WNASWSNKSLEQIWNNMTWMEWDREINNYTSLIHSL-NH2 | 699 |
| 794 | Ac-PWNASWSNKSLEQIWNNMTWMEWDREINNYTSLIHS-NH2 | 700 |
| 795 | Ac-VPWNASWSNKSLEQIWNNMTWMEWDREINNYTSLIH-NH2 | 701 |
| 796 | Ac-AVPWNASWSNKSLEQIWNNMTWMEWDREINNYTSLI-NH2 | 702 |
| 797 | Ac-TAVPWNASWSNKSLEQIWNNMTWMEWDREINNYTSL-NH2 | 703 |
| 798 | Ac-TTAVPWNASWSNKSLEQIWNNMTWMEWDREINNYTS-NH2 | 704 |
| 800 | Ac-AAASDEFDASISQVNEKINQSLAFIRKSDELLHNV-NH2 | 705 |
| 801 | Ac-VFPAAAFDASISQVNEKINQSLAFIRKSDELLHNV-NH2 | 706 |
| 802 | Ac-VFPSDEAASISQVNEKINQSLAFIRKSDELLHNV-NH2 | 707 |
| 803 | Ac-VFPSDEFDAAAAQVNEKINQSLAFIRKSDELLHNV-NH2 | 708 |
| 804 | Ac-VFPSDEFDASISAAAEKINQSLAFIRKSDELLHNV-NH2 | 709 |
| 805 | Ac-VFPSDEFDASISQVNAAANQSLAFIRKSDELLHNV-NH2 | 711 |

| T No. | Sequence | Seq. ID No. |
|---|---|---|
| 806 | Ac-VFPSDEFDASISQVNEKIAAALAFIRKSDELLHNV-NH2 | 712 |
| 807 | Ac-VFPSDEFDASISQVNEKINQSAAAIRKSDELLHNV-NH2 | 713 |
| 808 | Ac-VFPSDEFDASISQVNEKINQSLAFAAASDELLHNV-NH2 | 714 |
| 809 | Ac-VFPSDEFDASISQVNEKINQSLAFIRKAAALLHNV-NH2 | 715 |
| 810 | Ac-VFPSDEFDASISQVNEKINQSLAFIRKSDEAAANV-NH2 | 716 |
| 811 | Ac-VFPSDEFDASISQVNEKINQSLAFIRKSDELLAAA-NH2 | 717 |
| 812 | Ac-VYPSDEFDASISQVNEKINQSLAFIRKSDELLHNV-NH2 | 718 |
| 813 | Ac-AAAAIHSLIEESQNQQEKNEQELLELDKWASLWNWF-NH2 | 719 |
| 814 | Ac-YTSLIHSLIEESQQQQEKNEQELLELDKWASLWNWF-NH2 | 720 |
| 815 | Ac-YTSLIHSLIEESQNQQEKQEQELLELDKWASLWNWF-NH2 | 721 |
| 816 | Ac-QIWNNMTWMEWDREINNYTSLIHSLIEESQNQQEKQ-NH2 | 722 |
| 817 | Ac-QIWNNMTWMEWDREINNYTSLIHSLIEESQQQQEKN-NH2 | 723 |
| 818 | Ac-QIWNNMTWMEWDREINNYTSLIHSLIEESQQQQEKQ-NH2 | 724 |
| 819 | Ac-NKSLEQIWNNMTWMEWDREINNYTSLIHSLIEESQQ-NH2 | 725 |
| 820 | Ac-FDASISQVNEKINQSLAFIEESDELLHNVNAGKST-NH2 | 726 |
| 821 | Ac-ACIRKSDELCL-NH2 | 727 |
| 823 | Ac-YTSLIHSLIEESQNQQEKDEQELLELDKWASLWNWF-NH2 | 728 |
| 824 | Ac-YTSLIHSLIEESQDQQEKNEQELLELDKWASLWNWF-NH2 | 729 |
| 825 | Ac-YTSLIHSLIEESQDQQEKDEQELLELDKWASLWNWF-NH2 | 730 |
| 826 | Ac-YTSLIHSLIEESQNQQEKNEQELLELDKWASLWDWF-NH2 | 731 |
| 841 | Ac-LEANITQSLEQAQIQQEKNMYELQKLNSWDVFTNWL-NH2 | 732 |
| 842 | Ac-LEANISASLEQAQIQQEKNMYELQKLNSWDVFTNWL-NH2 | 733 |
| 843 | Ac-LEANISALLEQAQIQQEKNMYELQKLNSWDVFTNWL-NH2 | 734 |
| 844 | Ac-LEANITALLEQAQIQQEKNMYELQKLNSWDVFTNWL-NH2 | 735 |
| 845 | Ac-LEANITASLEQAQIQQEKNMYELQKLNSWDVFTNWL-NH2 | 736 |
| 845 | Ac-LEANITASLEQAQIQQEKNMYELQKLNSWDVFTNWL-NH2 | 736 |
| 846 | Ac-RAKFKQLLQHYREVAAAKSSENDRLRLLLKQMUPS-NH2 | 737 |
| 847 | Ac-Abu-DDE-Abu-MNSVKNGTYDYPKYEEESKLNRNEIKGVKL-NH2 | 738 |
| 856 | Ac-WQEWEQKVRYLEANISQSLEQAQIQQEKNMYELQKL-NH2 | 739 |
| 860 | Ac-DEYDASISQVNEKINQSLAFIRKSDELLHNVNAGK-NH2 | 740 |
| 861 | Ac-YTSLIHSLIEESQNQQEKNEQELLELDKWASLWN-NH2 | 741 |
| 862 | Ac-YTSLIHSLIEESQNQQEKNEQELLELDKWASLW-NH2 | 742 |
| 863 | Ac-YTSLIHSLIEESQNQQEKNEQELLELDKWASL-NH2 | 743 |
| 864 | Ac-YTSLIHSLIEESQNQQEKNEQELLELDKWAS-NH2 | 744 |
| 865 | Ac-QARQLLSGIVQQQNNLLRAIEAQQHLLQLTVWGIKQLQARILAVERYLKDQ-NH2 | 745 |
| 866 | Ac-DREINNYTSLIHSLIEESQNQQEKNEQELLELDKWASLWNWF-NH2 | 746 |
| 867 | Ac-NNMTWMEWDREINNYTSLIHSLIEESQNQQEKNEQELLELDK-NH2 | 747 |
| 868 | Ac-YTSLIHSLIEESQNQQEKNEQELLELDKWASLWAAA-NH2 | 748 |
| 869 | Ac-YTSLIHSLIEESQNQQEKNEQELLELDKWAAAANWF-NH2 | 749 |
| 870 | Ac-YTSLIHSLIEESQNQQEKNEQELLELDAAASLWNWF-NH2 | 750 |
| 871 | Ac-YTSLIHSLIEESQNQQEKNEQELLAAAKWASLWNWF-NH2 | 751 |
| 872 | Ac-YTSLIHSLIEESQNQQEKNEQAAAELDKWASLWNWF-NH2 | 752 |
| 873 | Ac-YTSLIHSLIEESQNQQEKAAAELLELDKWASLWNWF-NH2 | 753 |
| 874 | Ac-YTSLIHSLIEESQNQAAANEQELLELDKWASLWNWF-NH2 | 754 |
| 875 | Ac-YTSLIHSLIEESAAAQEKNEQELLELDKWASLWNWF-NH2 | 755 |
| 876 | Ac-YTSLIHSLIAAAQNQQEKNEQELLELDKWASLWNWF-NH2 | 756 |
| 877 | Ac-YTSLIHAAAEESQNQQEKNEQELLELDKWASLWNWF-NH2 | 757 |
| 878 | Ac-YTSAAASLIEESQNQQEKNEQELLELDKWASLWNWF-NH2 | 758 |
| 879 | Ac-EIWNNMTWMEWDRENEKINQSLAFIRKSDELLHNV-NH2 | 759 |
| 880 | Ac-YISEVNEEINQSLAFIRKADELLENVDKWASLWNWF-NH2 | 760 |

| T No. | Sequence | Seq. ID No. |
|---|---|---|
| 881 | Ac-TSVITIELSNIKENKANGTDAKVKLIKQELDKYKN-NH2 | 761 |
| 882 | YTSLIHSLIEESQNQQEKNEQELLELDKWASLWNWFMG-NH2 | 762 |
| 883 | Ac-NEKINQSLAFIRKSDELLHNV-NH2 | 763 |
| 884 | Biotin-YDPLVFPSDEFDASISQVNEKINQSLAFIRKSDEL-NH2 | 764 |
| 885 | Biotin-PLVFPSDEFDASISQVNEKINQSLAFIRKSDELLH-NH2 | 765 |
| 886 | Biotin-VFPSDEFDASISQVNEKINQSLAFIRKSDELLHNV-NH2 | 766 |
| 887 | Biotin-DEFDASISQVNEKINQSLAFIRKSDELLHNVNAGK-NH2 | 767 |
| 888 | Biotin-VYPSDEFDASISQVNEKINQSLAFIRKSDELLHNV-NH2 | 768 |
| 889 | Biotin-VYPSDEYDASISQVNEEINQALAYIRKADELLENV-NH2 | 769 |
| 890 | Ac-VYPSDEFDASISQVQEEIQQALAFIRKADELLEQV-NH2 | 770 |
| 891 | Ac-NYTSLIHSLIEESQNQQEKNEQELLELDKWASLWNWF-NH2 | 771 |
| 892 | Ac-NNYTSLIHSLIEESQNQQEKNEQELLELDKWASLWNWF-NH2 | 772 |
| 893 | Ac-INNYTSLIHSLIEESQNQQEKNEQELLELDKWASLWNWF-NH2 | 773 |
| 894 | Ac-EINNYTSLIHSLIEESQNQQEKNEQELLELDKWASLWNWF-NH2 | 774 |
| 895 | Ac-YTSLIHSLIEESQNQQEKNEQELLELDKWASLWNWFN-NH2 | 775 |
| 896 | Ac-YTSLIHSLIEESQNQQEKNEQELLELDKWASLWNWFNI-NH2 | 776 |
| 897 | Ac-YTSLIHSLIEESQNQQEKNEQELLELDKWASLWNWFNIT-NH2 | 777 |
| 898 | Ac-YTSLIHSLIEESQNQQEKNEQELLELDKWASLWNWFNITN-NH2 | 778 |
| 899 | Ac-YDPLVFPSDEFDASISQVNEKINQSLAFIRKSDELLHNVNAGK-NH2 | 779 |
| 900 | Ac-NYTSLIHSLIEESQNQQEKNEQELLELDKWASLWNWFN-NH2 | 780 |
| 901 | Ac-NNYTSLIHSLIEESQNQQEKNEQELLELDKWASLWNWFNI-NH2 | 781 |
| 905 | Ac-KCRAKFKQLLQHYREVAAAKSSENDRLRLLLKQMCPSLDVDSIIPRTPD-NH2 | 782 |
| 906 | Ac-RAKFKQLLQHYREVAAAKSSENDRLRLLLKQMCPSLDVDSIIPRTPD-NH2 | 783 |
| 907 | Ac-VYPSDEYDASISQVNEEINQALAYIAAADELLENV-NH2 | 784 |
| 909 | Ac-YDASISQVNEEINQALAYIRKADELL-NH2 | 785 |
| 910 | Ac-M-Nle-WMEWDREINNYTSLIHSLIEESQNQQEKNEQELLEL-NH2 | 786 |
| 911 | Ac-KNGTYDYPKYEEESKLNRNEIKGVKLSSMGVYQI-NH2 | 787 |
| 912 | Ac-VTEKIQMASDNINDLIQSGVNTRLLTIQSHVQNYI-NH2 | 788 |
| 913 | QNQQEKNEQELLELDKWASLWNWF-NH2 | 789 |
| 914 | Ac-QNQQEKNEQELLELDKWASLWNWF-NH2 | 790 |
| 915 | LWNWF-NH2 | 791 |
| 916 | ELLELDKWASLWNWF-NH2 | 792 |
| 917 | EKNEQELLELDKWASLWNWF-NH2 | 793 |
| 918 | SLIEESQNQQEKNEQELLELDKWASLWNWF-NH2 | 794 |
| 919 | Ac-YTSLIHSLIEESQNQQEKNEQELLELDKWASLWNW | 795 |
| 920 | Ac-YTSLIHSLIEESQNQQEKNEQELLELDKWASLWN | 796 |
| 921 | Ac-YTSLIHSLIEESQNQQEKNEQELLELDKWASLW | 797 |
| 922 | Ac-YTSLIHSLIEESQNQQEKNEQELLELDKWASL | 798 |
| 923 | TSLIHSLIEESQNQQEKNEQELLELDKWASLWNWF-NH2 | 799 |
| 924 | SLIHSLIEESQNQQEKNEQELLELDKWASLWNWF-NH2 | 800 |
| 925 | LIHSLIEESQNQQEKNEQELLELDKWASLWNWF-NH2 | 801 |
| 926 | IHSLIEESQNQQEKNEQELLELDKWASLWNWF-NH2 | 802 |
| 940 | Ac-AAVALLPAVLLALLAPSELEIKRYKNRVASRKCRAKFKQLLQHYREVAAAK-NH2 | 803 |
| 941 | Ac-AAVALLPAVLLALLAPCRAKFKQLLQHYREVAAAKSSENDRLRLLLKQMCP-NH2 | 804 |
| 942 | Ac-YTSLIHSLIEESQNQQEKNNNIERDWEMWTMNNWIQ-NH2 | 805 |
| 944 | VYPSDEYDASISQVNEEINQALAYIRKADELLENV-NH2 | 806 |
| 945 | Ac-LMQLARQLMQLARQMKQLADSLMQLARQVSRLESA-NH2 | 807 |
| 946 | Ac-WMEWDREINNYTSLIHSLIEESQNQQEKNEQELL-NH2 | 808 |
| 947 | Ac-MEWDREINNYTSLIHSLIEESQNQQEKNEQELLEL-NH2 | 809 |
| 948 | Ac-EWDREINNYTSLIHSLIEESQNQQEKNEQELLEL-NH2 | 810 |

| T No. | Sequence | Seq. ID No. |
|---|---|---|
| 949 | Ac-MEWDREINNYTSLIHSLIEESQNQQEKNEQELLE-NH2 | 811 |
| 950 | Biotin-W-Nle-EWDREINNYTSLIHSLIEESQNQQEKNEQELLEL-NH2 | 812 |
| 951 | Ac-YLEYDREINNYTSLIHSLIEESQNQQEKNEQELLEL-NH2 | 813 |
| 952 | Ac-IKQFINMWQEVGKAMYA-NH2 | 814 |
| 953 | Ac-IRKSDELL-NH2 | 815 |
| 954 | Decanoyl-IRKSDELL-NH2 | 815 |
| 955 | Acetyl-Aca-Aca-IRKSDELL-NH2 | 815 |
| 956 | Ac-YDASISQV-NH2 | 816 |
| 957 | Ac-NEKINQSL-NH2 | 817 |
| 958 | Ac-SISQVNEEINQALAYIRKADELL-NH2 | 818 |
| 959 | Ac-QVNEEINQALAYIRKADELL-NH2 | 819 |
| 960 | Ac-EEINQALAYIRKADELL-NH | 820 |
| 961 | Ac-NQALAYIRKADELL-NH2 | 821 |
| 962 | Ac-LAYIRKADELL-NH2 | 822 |
| 963 | FDASISQVNEKINQALAFIRKSDELL-NH2 | 823 |
| 964 | Ac-W-Nle-EWDREINNYTSLIHSLIEESQNQQEKNEQELLEL-NH2 | 824 |
| 965 | Ac-ASRKCRAKFKQLLQHYREVAAAKSSENDRLRLLLKQMCPSLDVDS-NH2 | 825 |
| 967 | Ac-WLEWDREINNYTSLIHSLIEESQNQQEKNEQELLEL-NH2 | 827 |
| 968 | Ac-YVKGEPIINFYDPLVFPSDEFDASISQVNEKINQSL-NH2 | 828 |
| 969 | Ac-VYPSDEYDASISQVNEEINQSLAYIRKADELLHNV-NH2 | 829 |
| 970 | Ac-YDASISQVNEEINQALAYIRKADELLENV-NH2 | 830 |
| 971 | Ac-YDASISQVNEEINQALAYIRKADELLE-NH2 | 831 |
| 972 | Ac-VYPSDEYDASISQVNEEINQALAYIRKAABELLHNV-NH2 | 832 |
| 973 | Ac-VYPSDEYDASISQVNEEINQALAYIRKALELLHNV-NH2 | 833 |
| 974 | Decanoyl-YTSLIHSLIEESQNQQEKNEQELLELDKWASLWNWF-NH2 | 834 |
| 975 | Ac-VYPSDEYDASISQVNEEINQLLAYIRKLDELLENV-NH2 | 835 |
| 976 | Ac-DEYDASISQVNEKINQSLAFIRKSDELL-NH2 | 836 |
| 977 | Ac-SNDQGSGYAADKESTQKAFDGITNKVNSVIEKTNT-NH2 | 837 |
| 978 | Ac-ESTQKAFDGITNKVNSVIEKTNTQFEAVGKEFGNLEKR-NH2 | 838 |
| 979 | Ac-DGITNKVNSVIEKTNTQFEAVGKEFGNLEKRLENLNK-NH2 | 839 |
| 980 | Ac-DSNVKNLYDKVRSQLRDNVKELGNGAFEFYHK-NH2 | 840 |
| 981 | Ac-RDNVKELGNGAFEFYHKADDEALNSVKNGTYDYPKY-NH2 | 841 |
| 982 | Ac-EFYHKADDEALNSVKNGTYDYPKY-NH2 | 842 |
| 983 | Ac-AAVALLPAVLLALLAPAADKESTQKAFDGITNKVNS-NH2 | 843 |
| 984 | Ac-AAVALLPAVLLALLAPAADSNVKNLYDKVRSQLRDN-NH2 | 844 |
| 985 | Ac-KESTQKAFDGITNKVNSV-NH2 | 845 |
| 986 | Ac-IEKTNTQFEAVGKEFGNLER-NH2 | 846 |
| 987 | Ac-RLENLNKRVEDGFLDVWTYNAELLVALENE-NH2 | 847 |
| 988 | Ac-SNVKNLYDKVRSQLRDN-NH2 | 848 |
| 989 | Ac-WMEWDREINNYTSLIHSLIEESQNQQEKNEQEL-NH2 | 849 |
| 990 | Ac-WMEWDREINNYTSLIHSLIEESQNQQEKNEQE-NH2 | 850 |
| 991 | Ac-MEWDREINNYTSLIHSLIEESQNQQEKNEQEL-NH2 | 851 |
| 992 | Ac-MEWDREINNYTSLIHSLIEESQNQQEKNEQE-NH2 | 852 |
| 993 | Ac-EWDREINNYTSLIHSLIEESQNQQEKNEQELLE-NH2 | 853 |
| 994 | Ac-EWDREINNYTSLIHSLIEESQNQQEKNEQELL-NH2 | 854 |
| 995 | Ac-EWDREINNYTSLIHSLIEESQNQQEKNEQEL-NH2 | 855 |
| 996 | Ac-YTKFIYTLLEESQNQQEKNEQELLELDKWASLWNWF-NH2 | 856 |
| 997 | Ac-YMKQLADSLMQLARQVSRLESA-NH2 | 857 |
| 998 | Ac-YLMQLARQMKQLADSLMQLARQVSRLESA-NH2 | 858 |
| 999 | Ac-YQEWERKVDFLEENITALLEEAQIQQEKNMYELQKL-NH2 | 859 |

| T No. | Sequence | Seq. ID No. |
|---|---|---|
| 1000 | Ac-WMAWAAAINNYTSLIHSLIEESQNQQEKNEQEEEEE-NH2 | 860 |
| 1001 | Ac-YASLIAALIEESQNQQEKNEQELLELAKWAALWAWF-NH2 | 861 |
| 1002 | [Ac-EWDREINNYTSLIHSLIEESQNQQEKNEQEGGC-NH2]dimer | 862 |
| 1003 | Ac-YDISIELNKAKSDLEESKEWIKKSNQKLDSIGNWH-NH2 | 863 |
| 1004 | Biotinyl-IDISIELNKAKSDLEESKEWIKKSNQKLDSIGNWH-NH2 | 864 |
| 1005 | Ac-YTSLI-OH | 865 |
| 1006 | Fmoc-HSLIEE-OH | 866 |
| 1007 | Fmoc-SQNQQEK-OH | 867 |
| 1008 | Fmoc-NEQELLEL-OH | 868 |
| 1009 | Fmoc-DKWASL-OH | 869 |
| 1010 | Fmoc-WNWF-OH | 870 |
| 1011 | Ac-AKTLERTWDTLNHLLFISSALYKLNLKSVAQITLSI-NH2 | 871 |
| 1012 | Ac-NITLQAKIKQFINMWQEVGKAMYA-NH2 | 872 |
| 1013 | Ac-LENERTLDFHDSNVKNLYDKVRLQLRDN-NH2 | 873 |
| 1014 | Ac-LENERTLDFHDSNVKNLYDKVRLQLRDNVKELGNG-NH2 | 874 |
| 1015 | Ac-TLDFHDSNVKNLYDKVRLQLRDNVKELGNGAFEF-NH2 | 875 |
| 1016 | Ac-IDISIELNKAKSDLEESKEWIKKSNQKLDSIGNWH-NH2 | 876 |
| 1021 | Biotinyl-SISQVNEEINQALAYIRKADELL-NH2 | 877 |
| 1022 | Biotinyl-SISQVNEEINQSLAYIRKSDELL-NH2 | 878 |
| 1023 | Ac-SISQVNEEINQSLAYIRKSDELL-NH2 | 879 |
| 1024 | Ac-IDISIELNKAKSDLEESKEWIEKSNQELDSIGNWE-NH2 | 39 |
| 1025 | Ac-IDISIELNKAKSDLEESKEWIKKSNQELDSIGNWH-NH2 | 864 |
| 1026 | Ac-IDISIELNKAKSDLEEAKEWIDDANQKLDSIGNWH-NH2 | 79 |
| 1027 | Ac-IDISIELNKAKSDLEESKEWIKKANQKLDSIGNWH-NH2 | 80 |
| 1028 | Ac-IDISIELNKAKSDLEEAKEWIKKSNQKLDSIGNWH-NH2 | 548 |
| 1029 | Biotinyl-NSVALDPIDISIELNKAKSDLEESKEWIKKSNQKL-NH2 | 880 |
| 1030 | Biotinyl-ALDPIDISIELNKAKSDLEESKEWIKKSNQKLDSI-NH2 | 881 |
| 1031 | desAminoTyrosine-NSVALDPIDISIELNKAKSDLEESKEWIKKSNQKL-NH2 | 882 |
| 1032 | desAminoTyrosine-ALDPIDISIELNKAKSDLEESKEWIKKSNQKLDSI-NH2 | 883 |
| 1033 | Ac-YDASISQVNEEINQALAFIRKADEL-NH2 | 984 |
| 1034 | Ac-YDASISQVNEEINQSLAYIRKADELL-NH2 | 985 |
| 1035 | Biotinyl-YDASISQVNEEINQALAYIRKADELL-NH2 | 986 |
| 1036 | Biotinyl-YDASISQVNEEINQSLAFIRKSDELL-NH2 | 987 |
| 1037 | Ac-YDASISQVNEEINQSLAFIRKSDELL-NH2 | 988 |
| 1038 | Ac-WLEWDREINNYTSLIHSLIEESQNQQEKNEQEL-NH2 | 989 |
| 1039 | Biotinyl-IDISIELNKAKSDLEESKEWIRRSNQKLDSIGNWH-NH2 | 916 |
| 1044 | Ac-YESTQKAFDGITNKVNSVIEKTNTQFEAVGKEFGNLEKR-NH2 | 81 |
| 1045 | Biotin-DEYDASISQVNEKINQSLAFIRKSDELL-NH2 | 82 |
| 1046 | Ac-MEWDREINNYTSLIHSLIEESQNQQEKNEQELL-NH2 | 90 |
| 1047 | Ac-WQEWEQKVRYLEANISQSLEQAQIQQEKNMYEL-NH2 | 892 |
| 1048 | Ac-WQEWEQKVRYLEANISQSLEQAQIQQEKNEYEL-NH2 | 893 |
| 1049 | Ac-WQEWEQKVRYLEANITALLEQAQIQQEKNEYEL-NH2 | 894 |
| 1050 | Ac-WQEWEQKVRYLEANITALLEQAQIQQEKNMYEL-NH2 | 895 |
| 1051 | Ac-WQEWEQKVRYLEANISQSLEQAQIQQEKNEYELQKL-NH2 | 896 |
| 1052 | Ac-WQEWEQKVRYLEANITALLEQAQIQQEKNEYELQKL-NH2 | 897 |
| 1053 | Ac-WQEWEQKVRYLEANITALLEQAQIQQEKNMYELQKL-NH2 | 898 |
| 1054 | Ac-IDISIELNKAKSDLEESKEWIEKSNQKLDSIGNWH-NH2 | |
| 1055 | Ac-EFGNLEKRLENLNKRVEDGFLDVWTYNAELLVALENE-NH2 | 899 |
| 1056 | Ac-EDGFLDVWTYNAELLVLMENERTLDFHDSNVKNLYDKVRMQL-NH2 | 900 |
| 1057 | Ac-SISQVNEKINQSLAFIRKSDELL-NH2 | 901 |

| T No. | Sequence | Seq. ID No. |
|---|---|---|
| 1058 | desaminoTyr-SISQVNEKINQSLAFIRKSDELL-NH2 | 902 |
| 1059 | Ac-SISQVNEKINQSLAYIRKSDELL-NH2 | 903 |
| 1060 | Ac-QQLLDVVKRQQEMLRLTVWGTKNLQARVTAIEKYLKDQ-NH2 | 904 |
| 1061 | YTSLIHSLIEESQNQQEKNEQELLELDKWASLWNWFC | 905 |
| 1062 | Ac-FDASISQVNEKINQSLAYIRKSDELL-NH2 | 906 |
| 1063 | Ac-YTSLIHSLIEESQNQQEKNEQELLELDKWA | 907 |
| 1064 | Indole-3-acetyl-DEFDASISQVNEKINQSLAFIRKSDELL-NH2 | 908 |
| 1065 | Indole-3-acetyl-DEFDESISQVNEKINQSLAFIRKSDELL-NH2 | 909 |
| 1066 | Indole-3-acetyl-DEFDESISQVNEKIEQSLAFIRKSDELL-NH2 | 910 |
| 1067 | Indole-3-acetyl-DEFDESISQVNEKIEESLAFIRKSDELL-NH2 | 911 |
| 1068 | Indole-3-acetyl-DEFDESISQVNEKIEESLQFIRKSDELL-NH2 | 912 |
| 1069 | Indole-3-acetyl-GGGGGDEFDASISQVNEKINQSLAFIRKSDELL-NH2 | 913 |
| 1070 | 2-Napthoyl-DEFDASISQVNEKINQSLAFIRKSDELL-NH2 | 914 |
| 1071 | desNH2Tyr-DEFDASISQVNEKINQSLAFIRKSDELL-NH2 | 915 |
| 1072 | biotin-ALDPIDISIELNKAKSDLEESKEWIRRSNQKLDSI-NH2 | 916 |
| 1073 | Ac-YDASISQVNEKINQALAYIRKADELLHNVNAGKST-NH2 | 917 |
| 1074 | Ac-VYPSDEYDASISQVNEKINQALAYIRKADELLHNV-NH2 | 918 |
| 1075 | Ac-VYPSDEYDASISQVNEKINQSLAYIRKSDELLHNV-NH2 | 718 |
| 1076 | Ac-WGWGYGYG-NH2 | 919 |
| 1077 | Ac-YGWGWGWGF-NH2 | 920 |
| 1078 | Ac-WQEWEQKVRYLEANITALQEQAQIQAEKAEYELQKL-NH2 | 921 |
| 1079 | Ac-WQEWEQKVRYLEAEITALQEEAQIQAEKAEYELQKL-NH2 | 922 |
| 1081 | Ac-YTSLIHSLIEESQNQQEKNEQELLELDKWAS | 923 |
| 1082 | Ac-VWPSDEFDASISQVNEKINQSLAFIRKSDELLHNV-NH2 | 924 |
| 1083 | Ac-SKNISEQIDQIKKDEQKEGTGWGLGGKWWTSDWGV-NH2 | 925 |
| 1084 | Ac-LSKNISEQIDQIKKDEQKEGTGWGLGGKWWTSDWG-NH2 | 926 |
| 1085 | Ac-DLSKNISEQIDQIKKDEQKEGTGWGLGGKWWTSDW-NH2 | 927 |
| 1086 | Ac-EDLSKNISEQIDQIKKDEQKEGTGWGLGGKWWTSD-NH2 | 928 |
| 1087 | Ac-IEDLSKNISEQIDQIKKDEQKEGTGWGLGGKWWTS-NH2 | 929 |
| 1088 | Ac-GIEDLSKNISEQIDQIKKDEQKEGTGWGLGGKWWT-NH2 | 930 |
| 1089 | Ac-IGIEDLSKNISEQIDQIKKDEQKEGTGWGLGGKWW-NH2 | 931 |
| 1090 | 2-Napthoyl--PSDEFDASISQVNEKINQSLAFIRKSDELLHNVN-NH2 | 932 |
| 1091 | Ac-VYPSDEYDASISQVNEKINQALAYIRKADELLENV-NH2 | 933 |
| 1092 | Ac-VYPSDEFDASISQVNEKINQALAFIRKADELLENV-NH2 | 934 |
| 1093 | Ac-VYPSDEYDASISQVNEKINQALAYIREADELLENV-NH2 | 935 |
| 1094 | Biotinyl-YDASISQVNEKINQSLAFIRESDELL-NH2 | 936 |
| 1095 | Ac-AIGIEDLSKNISEQIDQIKKDEQKEGTGWGLGGKW-NH2 | 937 |
| 1096 | Ac-AAIGIEDLSKNISEQIDQIKKDEQKEGTGWGLGGK-NH2 | 938 |
| 1097 | Ac-DAAIGIEDLSKNISEQIDQIKKDEQKEGTGWGLGG-NH2 | 939 |
| 1098 | Ac-PDAAIGIEDLSKNISEQIDQIKKDEQKEGTGWGLG-NH2 | 940 |
| 1099 | Ac-NITDKIDQIIHDFVDKTLPDQGDNDNWWTGWRQWI-NH2 | 941 |
| 1100 | Ac-KNITDKIDQIIHDFVDKTLPDQGDNDNWWTGWRQW-NH2 | 942 |
| 1101 | Ac-TKNITDKIDQIIHDFVDKTLPDQGDNDNWWTGWRQ-NH2 | 943 |
| 1102 | Ac-WTKNITDKIDQIIHDFVDKTLPDQGDNDNWWTGWR-NH2 | 944 |
| 1103 | Ac-DWTKNITDKIDQIIHDFVDKTLPDQGDNDNWWTGW-NH2 | 945 |
| 1104 | Ac-HDWTKNITDKIDQIIHDFVDKTLPDQGDNDNWWTG-NH2 | 946 |
| 1105 | Ac-PHDWTKNITDKIDQIIHDFVDKTLPDQGDNDNWWT-NH2 | 947 |
| 1106 | Ac-EPHDWTKNITDKIDQIIHDFVDKTLPDQGDNDNWW-NH2 | 948 |
| 1107 | Ac-IEPHDWTKNITDKIDQIIHDFVDKTLPDQGDNDNW-NH2 | 949 |
| 1108 | Ac-AIEPHDWTKNITDKIDQIIHDFVDKTLPDQGDNDN-NH2 | 950 |

| T No. | Sequence | Seq. ID No. |
|---|---|---|
| 1109 | Ac-AAIEPHDWTKNITDKIDQIIHDFVDKTLPDQGDND-NH2 | 951 |
| 1110 | Ac-DAAIEPHDWTKNITDKIDQIIHDFVDKTLPDQGDN-NH2 | 952 |
| 1111 | Ac-LSPTVWLSVIWMMWYWGPSLYSILSPFLPLLPIFF-NH2 | 953 |
| 1112 | Ac-GLSPTVWLSVIWMMWYWGPSLYSILSPFLPLLPIF-NH2 | 1345 |
| 1113 | Ac-VGLSPTVWLSVIWMMWYWGPSLYSILSPFLPLLPI-NH2 | 1346 |
| 1114 | Ac-FVGLSPTVWLSVIWMMWYWGPSLYSILSPFLPLLP-NH2 | 1347 |
| 1115 | Ac-WFVGLSPTVWLSVIWMMWYWGPSLYSILSPFLPLL-NH2 | 1348 |
| 1116 | Ac-QWFVFLSPTVWLSVIWMMWYWGPSLYSILSPFLPL-NH2 | 1349 |
| 1117 | Ac-VQWFVGLSPTVWLSVIWMMWYWGPSLYSILSPFLP-NH2 | 1350 |
| 1118 | Ac-FVQWFVGLSPTVWLSVIWMMWYWGPSLYSILSPFL-NH2 | 1351 |
| 1119 | Ac-PFVQWFVGLSPTVWLSVIWMMWYWGPSLYSILSPF-NH2 | 1352 |
| 1120 | Ac-VPFVQWFVGLSPTVWLSVIWMMWYWGPSLYSILSP-NH2 | 1353 |
| 1121 | Ac-LVPFVQWFVGLSPTVWLSVIWMMWYWGPSLYSILS-NH2 | 1354 |
| 1122 | H-NHTTWMEWDREINNYTSLIHSLIEESQNQQEKNEQELLELDKW-OH | 954 |
| 1123 | H-QARQLLSGIVQQQNNLLRAIEAQQHLLQLTVWGIKQLQARILAVERYLKDQ-OH | 955 |
| 1124 | Ac-VYPSDEFDASISQVNEKINQSLAFIREADELLENV-NH2 | 956 |
| 1125 | Ac-VFPSDEFDASISQVNEKINQSLAYIREADELLENV-NH2 | 957 |
| 1126 | Ac-DEFDASISQVNEKINQSLAYIREADELL-NH2 | 958 |
| 1127 | Ac-NEQELLELDKWASLWNWFGGGGDEFDASISQVNEKINQSLAFIRKSDELL-NH2 | 959 |
| 1128 | Ac-LELDKWASLWNWFGGGGDEFDASISQVNEKINQSLAFIRKSDELL-NH2 | 960 |
| 1129 | Naphthoyl-EGEGEGEGDEFDASISQVNEKINQSLAFIRKSDELL-NH2 | 961 |
| 1130 | Ac-ASRKCRAKFKQLLQHYREVAAAKSSENDRLRLLLKQMCPSLDV-NH2 | 962 |
| 1131 | Naphthoyl-GDEEDASISQVNEKINQSLAFIRKSDELL-NH2 | 963 |
| 1132 | Naphthoyl-GDEEDASESQVNEKINQSLAFIRKSDELL-NH2 | 964 |
| 1133 | Naphthoyl-GDEEDASESQQNEKINQSLAFIRKSDELL-NH2 | 965 |
| 1134 | Naphthoyl-GDEEDASESQQNEKQNQSLAFIRKSDELL-NH2 | 966 |
| 1135 | Naphthoyl-GDEEDASESQQNEKQNQSEAFIRKSDELL-NH2 | 967 |
| 1136 | Ac-WGDEFDESISQVNEKIEESLAFIRKSDELL-NH2 | 968 |
| 1137 | Ac-YTSLGGDEFDESISQVNEKIEESLAFIRKSDELLGGWNWF-NH2 | 969 |
| 1138 | Ac-YTSLIHSLGGDEFDESISQVNEKIEESLAFIRKSDELLGGWASLWNWF-NH | 970 |
| 1139 | 2-Naphthoyl-GDEFDESISQVNEKIEESLAFIRKSDELL-NH2 | 971 |
| 1140 | 2-Naphthoyl-GDEEDESISQVNEKIEESLAFIRKSDELL-NH2 | 972 |
| 1141 | 2-Naphthoyl-GDEEDESISQVQEKIEESLAFIRKSDELL-NH2 | 973 |
| 1142 | 2-Naphthoyl-GDEEDESISQVQEKIEESLLFIRKSDELL-NH2 | 974 |
| 1143 | Biotin-GDEYDESISQVNEKIEESLAFIRKSDELL-NH2 | 975 |
| 1144 | 2-Naphthoyl-GDEYDESISQVNEKIEESLAFIRKSDELL-NH2 | 976 |
| 1145 | Ac-YTSLIHSLIDEQEKIEELAFIRKSDELLELDKWNWF-NH2 | 977 |
| 1146 | VYPSDEYDASISQVNEEINQALAYIRKADELLENV-NH2 | 978 |
| 1147 | Ac-NNLLRAIEAQQHLLQLTVWGSKQLQARILAVERYLKDQ-NH2 | 979 |
| 1148 | GGGVYPSDEYDASISQVNEEINQALAYIRKADELLENV-NH2 | 980 |
| 1149 | Ac-NNLLRAIEAQQHLLQLTVWGEKQLQARILAVERYLKDQ-NH2 | 981 |
| 1150 | Ac-PTRVNYILIIGVLVLAbuEVTGVRADVHLL-NH2 | 982 |
| 1151 | Ac-PTRVNYILIIGVLVLAbuEVTGVRADVHLLEQPGNLW-NH2 | 983 |
| 1152 | Ac-PEKTPLLPTRVNYILIIGVLVLAbuEVTGVRADVHLL-NH2 | 984 |
| 1153 | AhaGGGVYPSDEYDASISQVNEEINQALAYIRKADELLENV-NH2 | 985 |
| 1155 | Ac-YTSLIHSLGGDEFDESISQVNEKIEESLAFIRKSDELL-NH2 | 986 |
| 1156 | Ac-YTSLGGDEFDESISQVNEKIEESLAFIRKSDELL-NH2 | 987 |
| 1157 | Ac-DEFDESISQVNEKIEESLAFIRKSDELLGGWASLWNWF-NH2 | 988 |
| 1158 | Ac-DEFDESISQVNEKIEESLAFIRKSDELLGGWNWF-NH2 | 989 |
| 1159 | Ac-YTSLIHSLIEESQNQQEKNEQELLELDKASLWNWF-NH2 | 990 |

| T No. | Sequence | Seq. ID No. |
|---|---|---|
| 1160 | Ac-YTSLIHSLIEESQNQQEKNEQELLELDKSLWNWF-NH2 | 991 |
| 1161 | Ac-YTSLIHSLIEESQNQQEKNEQELLELDKLWNWF-NH2 | 992 |
| 1162 | Ac-YTSLIHSLIEESQNQQEKNEQELLELDKWNWF-NH2 | 993 |
| 1163 | Ac-MTWMEWDREINNYTSLIHSLIEESQNQQEKNEQELLELDKASLWNWF-NH2 | 994 |
| 1164 | Ac-MTWMEWDREINNYTSLIHSLIEESQNQQEKNEQELLELDKSLWNWF-NH2 | 995 |
| 1165 | Ac-MTWMEWDREINNYTSLIHSLIEESQNQQEKNEQELLELDKLWNWF-NH2 | 996 |
| 1166 | Ac-MTWMEWDREINNYTSLIHSLIEESQNQQEKNEQELLELDKWNWF-NH2 | 997 |
| 1167 | Ac-MTWMEWDREINNYTSLIHSLIEESQNQQEKNEQELLELDKWASLWN-NH2 | 998 |
| 1168 | Ac-MTWMEWDREINNYTSLIHSLIEESQNQQEKNEQELLELDKWASL-NH2 | 999 |
| 1169 | (Pyr)HWSY(2-napthyl-D-Ala)LRPG-NH2 | 1000 |
| 1170 | Ac-WNWFDEFDESISQVNEKIEESLAFIRKSDELLWNWF-NH2 | 1001 |
| 1171 | Ac-YTSLIHSLIEESQNQQEKNEQELLELDKYASLYNYF-NH2 | 1002 |
| 1172 | Ac-YTSLIHSLIEESQNQQEKNEQELLELDKYAYLYNYF-NH2 | 1003 |
| 1173 | 2-Naphthoyl-AcaAcaAcaDEFDESISQVNEKIEESLAFIRKSDELLAcaAcaAcaW-NH2 | 1004 |
| 1174 | 2-Naphthoyl-AcaAcaAcaGDEFDESISQVNEKIEESLAFIRKSDELLGAcaAcaAcaW-NH2 | 1005 |
| 1175 | 2-Naphthoyl-GDEFDESISQVNEKIEESLAFIRESDELL-NH2 | 1006 |
| 1176 | 2-Naphthoyl-GDEFDESISQVNEKIEESLAFIEESDELL-NH2 | 1007 |
| 1177 | Ac-WQEWEQKVNYLEANITALLEQAQIQQEKNEYELQKL-NH2 | 1008 |
| 1178 | Ac-WQEWEQKVDYLEANITALLEQAQIQQEKNEYELQKL-NH2 | 1009 |
| 1179 | Ac-WQEWEQKVRWLEANITALLEQAQIQQEKNEYELQKL-NH2 | 1010 |
| 1180 | Ac-WQEWEKQVRYLEANITALLEQAQIQQEKNEYELQKL-NH2 | 1011 |
| 1181 | Ac-WQEWEHQVRYLEANITALLEQAQIQQEKNEYELQKL-NH2 | 1012 |
| 1182 | Ac-WQEWEHKVRYLEANITALLEQAQIQQEKNEYELQKL-NH2 | 1013 |
| 1183 | Ac-WQEWDREVRYLEANITALLEQAQIQQEKNEYELQKL-NH2 | 1014 |
| 1184 | Ac-WQEWEREVRYLEANITALLEQAQIQQEKNEYELQKL-NH2 | 1015 |
| 1185 | Ac-WQEWERQVRYLEANITALLEQAQIQQEKNEYELQKL-NH2 | 1016 |
| 1186 | Ac-WQEWEQKVKYLEANITALLEQAQIQQEKNEYELQKL-NH2 | 1017 |
| 1187 | Ac-WQEWEQKVRFLEANITALLEQAQIQQEKNEYELQKL-NH2 | 1018 |
| 1188 | Ac-VNalPSDEYDASISQVNEEINQALAYIRKADELLENV-NH2 | 1019 |
| 1189 | Ac-VNalPSDENalDASISQVNEEINQALAYIRKADELLENV-NH2 | 1020 |
| 1190 | Ac-VNalPSDEYDASISQVNEEINQALANalIRKADELLENV-NH2 | 1021 |
| 1191 | Ac-VYPSDEFDASISQVNEKINQSLAFIREADELLFNFF-NH2 | 1022 |
| 1192 | Ac-VYPSDEYDASISQVNEEINQALAYIRKADELLFNFF-NH2 | 1023 |
| 1193 | Ac-YTSLITALLEQAQIQQEKNEYELQKLDKWASLWNWF-NH2 | 1024 |
| 1194 | Ac-YTSLITALLEQAQIQQEKNEYELQKLDKWASLWEWF-NH2 | 1025 |
| 1195 | Ac-YTSLITALLEQAQIQQEKNEYELQKLDEWASLWEWF-NH2 | 1026 |
| 1196 | Ac-YTSLITALLEQAQIQQEKNEYELQELDEWASLWEWF-NH2 | 1027 |
| 1197 | Ac-YTSLITALLEEAQIQQEKNEYELQELDEWASLWEWF-NH2 | 1028 |
| 1198 | Naphthoyl-Aua-Aua-Aua-TALLEQAQIQQEKNEYELQKLAua-Aua-Aua-W-NH2 | 1029 |
| 1199 | Ac-WAAWEQKVRYLEANITALLEQAQIQQEKNEYELQKL-NH2 | 1030 |
| 1200 | Ac-WQEAAQKVRYLEANITALLEQAQIQQEKNEYELQKL-NH2 | 1031 |
| 1201 | Ac-WQEWAAKVRYLEANITALLEQAQIQQEKNEYELQKL-NH2 | 1032 |
| 1202 | Ac-WQAAEQKVRYLEANITALLEQAQIQQEKNEYELQKL-NH2 | 1033 |
| 1203 | Ac-WQEWEAAVRYLEANITALLEQAQIQQEKNEYELQKL-NH2 | 1034 |
| 1204 | Ac-WQEWEQAARYLEANITALLEQAQIQQEKNEYELQKL-NH2 | 1035 |
| 1205 | Ac-WQEWEQKAAYLEANITALLEQAQIQQEKNEYELQKL-NH2 | 1036 |
| 1206 | Ac-WQEWEQKVAALEANITALLEQAQIQQEKNEYELQKL-NH2 | 1037 |
| 1207 | Ac-WQEWEQKVRYLEANITALLEQAQIQQEKNEYELQKLGGGGWASLWNF-NH2 | 1038 |
| 1208 | 2-Naphthoyl-GDEFDASISQVNEKINQSLAFIRKSDELT-NH2 | 1039 |
| 1209 | 2-Naphthoyl-GDEFDASISQVNEKINQSLAFTRKSDELT-NH2 | 1040 |

| T No. | Sequence | Seq. ID No. |
|---|---|---|
| 1210 | 2-Naphthoyl-GDEFDASISQVNEKTNQSLAFTRKSDELT-NH2 | 971 |
| 1211 | 2-Naphthoyl-GDEFDASISQTNEKTNQSLAFTRKSDELT-NH2 | 1038 |
| 1212 | 2-Naphthoyl-GDEFDASTSQTNEKTNQSLAFTRKSDELT-NH2 | 1039 |
| 1213 | 2-Naphthoyl-GDEYDASTSQTNEKTNQSLAFTRKSDELT-NH2 | 1040 |
| 1214 | 2-Naphthoyl-GDEFDEEISQVNEKIEESLAFIRKSDELL-NH2 | 1041 |
| 1215 | 2-Naphthoyl-GDEFDASISQVNEKINQSLAFIRKSDELA-NH2 | 1042 |
| 1216 | 2-Naphthoyl-GDEFDASASQANEKANQSLAFARKSDELA-NH2 | 1043 |
| 1217 | 2-Naphthoyl-GDEFDESISQVNEKIEESLAFTRKSDELL-NH2 | 1044 |
| 1218 | 2-Naphthoyl-GDEFDESISQVNEKTEESLAFIRKSDELL-NH2 | 1045 |
| 1219 | 2-Naphthoyl-GDEFDESISQTNEKIEESLAFIRKSDELL-NH2 | 1046 |
| 1220 | 2-Naphthoyl-GDEFDESTSQVNEKIEESLAFIRKSDELL-NH2 | 1047 |
| 1221 | Ac-WNWFDEFDESTSQVNEKIEESLAFIRKSDELLWNWF-NH2 | 1048 |
| 1222 | Ac-WNWFDEFDESTSQTNEKIEESLAFIRKSDELLWNWF-NH2 | 1049 |
| 1223 | Ac-WNWFDEFDESTSQTNEKTEESLAFIRKSDELLWNWF-NH2 | 1050 |
| 1224 | Ac-LQAGFFLLTRILTIPQSLDSWWTSLNFLGGTTVAL-NH2 | 1355 |
| 1225 | Ac-YTNLIYTLLEESQNQQEKNEQELLELDKWASLWSWF-NH2 | 1051 |
| 1226 | Ac-WQEWEQKVRYLEANITALLEQAQIQQEKNEYELQKLDKWASLWNWF-NH2 | 1052 |
| 1227 | Ac-NNMTWQEWEQKVRYLEANITALLEQAQIQQEKNEYELQKLDKWASLWNWF-NH2 | 1053 |
| 1230 | Ac-WNWFIEESDELLWNWF-NH2 | 1054 |
| 1231 | 2-Naphthoyl-GFIEESDELLW-NH2 | 1055 |
| 1232 | Ac-WFIEESDELLW-NH2 | 1056 |
| 1233 | 2-Naphthoyl-GFNFFIEESDELLFNFF-NH2 | 1057 |
| 1234 | 2-Naphthoyl-GESDELW-NH2 | 1058 |
| 1235 | Ac-WNWFGDEFDESISQVQEEIEESLAFIEESDELLGGWNWF-NH2 | 1059 |
| 1236 | Ac-WNWFIHSLIEESQNQQEKNEQELLELDKWASLWNWF-NH2 | 1356 |
| 1237 | Ac-YTSLITALLEQAQIQQEENEYELQALDEWASLWEWF-NH2 | 1025 |
| 1238 | Ac-YTSLIHSLGGDEFDESISQVNEEIEESLAFIEESDELLGGWASLWNWF-NH2 | 1060 |
| 1239 | 2-Naphthoyl-GDEFDESISQVQEEIEESLAFIEESDELL-NH2 | 1061 |
| 1240 | H-QARQLLSSIMQQQNNLLRAIEAQQHLLQLTVWGIKQLQARILAVERYLKDQ-OH | 1062 |
| 1241 | Ac-CPKYVKQNTLKLATGMRNVPEKQTR-NH2 | 1063 |
| 1242 | Ac-GLFGAIAGFIENGWEGMIDGWYGFRHQNSC-NH2 | 1064 |
| 1243 | Ac-LNFLGGT-NH2 | 1065 |
| 1244 | Ac-LDSWWTSLNFLGGT-NH2 | 1066 |
| 1245 | Ac-ILTIPQSLDSWWTSLNFLGGT-NH2 | 1067 |
| 1246 | Ac-GFFLLTRILTIPQSLDSWWTSLNFLGGT-NH2 | 1068 |
| 1247 | Ac-WQEWEQKITALLEQAQIQQEKNEYELQKLDKWASLWNWF-NH2 | 1069 |
| 1248 | Ac-WNWFITALLEQAQIQQEKNEYELQKLDKWASLWNWF-NH2 | 1070 |
| 1249 | Ac-WQEWEQKITALLEQAQIQQEKNEYELQKLDKWASLWEWF-NH2 | 1071 |
| 1250 | Ac-WQEWEQKVRYLEANITALLEQAQIQQEKIEYELQKL-NH2 | 1072 |
| 1251 | Ac-WQEWEQKVRYLEAQITALLEQAQIQQEKIEYELQKL-NH2 | 1073 |
| 1252 | Ac-KENKANGTDAKVKLIKQELDKYKNAVTELQLLMQS-NH2 | 1074 |
| 1253 | Ac-NIKENKANGTDAKVKLIKQELDKYKNAVTELQLLM-NH2 | 1075 |
| 1254 | (FS)-YTSLIHSLIEESQNQQEKNEQELLELDKWASLWNWF-NH2 | 1076 |
| 1255 | 2-Naphthoyl-GWNWFAcaDEFDESISQVQEEIEESLAFIEESDELLAcaWNWF-NH2 | 1077 |
| 1256 | Ac-WNWFGDEFDESISQVNEKIEESLAFIEESDELLGWNWF-NH2 | 1078 |
| 1257 | Ac-WNWFGDEFDESISQVNEKIEESLAFIRKSDELLGWNWF-NH2 | 1079 |
| 1258 | Ac-WNWF-Aca-DEFDESISQVNEKIEESLAFIRKSDELL-Aca-WNWF-NH2 | 1080 |
| 1259 | Ac-WNWF-Aca-DEFDESISQVNEKIEESLAFIEESDELL-Aca-WNWF-NH2 | 1081 |
| 1260 | Ac-EESQNQQEKNEQELLELDKWA-NH2 | 1082 |
| 1261 | EESQNQQEKNEQELLELDKWA | 1083 |

| T No. | Sequence | Seq. ID No. |
|---|---|---|
| 1262 | Ac-CGTTDRSGAPTYSWGANDTDVFVLNNTRPPLGNWFG-NH2 | 1084 |
| 1263 | Ac-GVEHRLEAACNWTRGERADLEDRDRSELSP-NH2 | 1085 |
| 1264 | Ac-CVREGNASRAWVAVTPTVATRDGKLPT-NH2 | 1086 |
| 1265 | Ac-CFSPRHHWTTQDANASIYPG-NH2 | 1087 |
| 1266 | Ac-LQHYREVAAAKSSENDRLRLLLKQMCPSLDVDS-NH2 | 1088 |
| 1267 | Ac-WQEWDREISNYTSLITALLEQAQIQQEKNEYELQKLDEWASLWEWF-NH2 | 1089 |
| 1268 | Ac-CWQEWDREISNYTSLITALLEQAQIQQEKNEYELQKLDEWASLWEWFC-NH2 | 1090 |
| 1269 | Ac-WQEWDREISNYTSLITALLEQAQIQQEKNEYELQKLDEWEWF-NH2 | 1091 |
| 1270 | Ac-CWQEWDREISNYTSLITALLEQAQIQQEKNEYELQKLDEWEWFC-NH2 | 1092 |
| 1271 | Ac-GQNSQSPTSNHSPTSAPPTAPGYRWA-NH2 | 1093 |
| 1272 | Ac-PGSSTTSTGPARTALTTAQGTSLYPSA-NH2 | 1094 |
| 1273 | Ac-PGSSTTSTGPARTALTTAQGTSLYPSAAATKPSDGNATA-NH2 | 1095 |
| 1275 | Ac-WQEWDREITALLEQAQIQQEKNEYELQKLDKWASLWNWF-NH2 | 1097 |
| 1276 | Ac-WQEWDREITALLEQAQIQQEKNEYELQKLDEWASLWEWF-NH2 | 1098 |
| 1277 | Ac-WQEWDREITALLEQAQIQQEKNEYELQKLDEWEWF-NH2 | 1099 |
| 1278 | Ac-WQEWDREITALLEQAQIQQEKNEYELQKLDEWEWF-NH2 | 1100 |
| 1279 | Ac-WQEWEREITALLEQAQIQQEKNEYELQKLIEWEWF-NH2 | 1101 |
| 1280 | Ac-WQEWEREITALLEQAQIQQEKIEYELQKLDEWEWF-NH2 | 1102 |
| 1281 | Ac-WQEWEITALLEQAQIQQEKNEYELQKLDEWEWF-NH2 | 1103 |
| 1282 | Ac-WQEWEITALLEQAQIQQEKNEYELQKLIEWEWF-NH2 | 1104 |
| 1283 | Ac-WQEWEITALLEQAQIQQEKIEYELQKLDEWEWF-NH2 | 1105 |
| 1284 | Ac-WQEWEITALLEQAQIQQEKIEYELQKLIEWEWF-NH2 | 1106 |
| 1285 | Ac-WQEWDREIDEYDASISQVNEKINQALAYIREADELWEWF-NH2 | 1107 |
| 1286 | Ac-WQEWEREIDEYDASISQVNEKINQALAYIREADELWEWF-NH2 | 1108 |
| 1287 | Ac-WQEWEIDEYDASISQVNEKINQALAYIREADELWEWF-NH2 | 1109 |
| 1288 | Ac-WQEWDREIDEYDASISQVNEEINQALAYIREADELWEWF-NH2 | 1110 |
| 1289 | Ac-WQEWEREIDEYDASISQVNEEINQALAYIREADELWEWF-NH2 | 1111 |
| 1290 | Ac-WQEWEIDEYDASISQVNEEINQALAYIREADELWEWF-NH2 | 1112 |
| 1291 | Ac-WQEWDEYDASISQVNEKINQALAYIREADELWEWF-NH2 | 1113 |
| 1292 | Ac-WQEWDEYDASISQVNEEINQALAYIREADELWEWF-NH2 | 1114 |
| 1293 | Ac-WQEWEQKITALLEQAQIQQEKIEYELQKLIEWEWF-NH2 | 1115 |
| 1294 | Ac-WQEWEQKITALLEQAQIQQEKIEYELQKLIEWASLWEWF-NH2 | 1116 |
| 1295 | Ac-WQEWEITALLEQAQIQQEKIEYELQKLIEWASLWEWF-NH2 | 1117 |
| 1298 | -VYPSDEYDASISQVNEEINQALAYIRKADELLENV-NH2 | 1160 |
| 1299 | Ac-WVYPSDEYDASISQVNEEINQALAYIRKADELLENVWNWF-NH2 | 1120 |
| 1300 | YTSLIHSLIEESQNQQEKNEQELLELDKWASLWNWF-NH2 | 1121 |
| 1301 | Ac-WQEWDEYDASISQVNEKINQALAYIREADELWAWF-NH2 | 1122 |
| 1302 | Ac-WQAWDEYDASISQVNEKINQALAYIREADELWAWF-NH2 | 1123 |
| 1303 | Ac-WQAWDEYDASISQVNEKINQALAYIREADELWEWF-NH2 | 1124 |
| 1304 | Biotin-YDPLVFPSDEFDASISQVNEKINQSLAFIRKSDEL-NH2 | 1125 |
| 1305 | Biotin-YDPLVFPSDEFDASISQVNEKINQSLAF-NH2 | 1126 |
| 1306 | Biotin-QVNEKINQSLAFIRKSDELLHNVNAGKST-NH2 | 1127 |
| 1307 | Ac-WMEWDREI-NH2 | 1128 |
| 1308 | Ac-WQEWEQKI-NH2 | 1129 |
| 1309 | Ac-WQEWEQKITALLEQAQIQQEKIEYELQKLIKWASLWEWF-NH2 | 1130 |
| 1310 | Ac-WQEWEQKITALLEQAQIQQEKIEYELQKLIEWASLWEWF-NH2 | 1131 |
| 1311 | Ac-WQEWEREISAYTSLITALLEQAQIQQEKIEYELQKLIEWEWF-NH2 | 1132 |
| 1312 | Ac-WQEWEREISAYTSLITALLEQAQIQQEKIEYELQKEWEWF-NH2 | 1133 |
| 1313 | Ac-WQEWEREISAYTSLITALLEQAQIQQEKIEYELQKEWEW-NH2 | 1134 |
| 1314 | Ac-WQEWEREISAYTSLITALLEQAQIQQEKIEYELQKLIEWEW-NH2 | 1135 |

| T No. | Sequence | Seq. ID No. |
|---|---|---|
| 1315 | Ac-FNLSDHSESIQKKFQLMKKHVNKIGVDSDPIGSWLR-NH2 | 1136 |
| 1316 | Ac-DHSESIQKKFQLMKKHVNKIGVDSDPIGSWLRGIF-NH2 | 1137 |
| 1317 | Ac-WSVKQANLTTSLLGDLLDDVTSIRHAVLQNRA-NH2 | 1138 |
| 1318 | Biotin-WMEWDREI-NH2 | 1128 |
| 1319 | Biotin-NNMTWMEWDREINNYTSL-NH2 | 1139 |
| 1320 | Ac-GAASLTLTVQARQLLSGIVQQQNNLLRAIEAQQHLL-NH2 | 1140 |
| 1321 | Ac-ASLTLTVQARQLLSGIVQQQNNLLRAIEAQQHLLQL-NH2 | 1141 |
| 1322 | Ac-VSVGNTLYYVNKQEGKSLYVKGEPIINFYDPLVF-NH2 | 1142 |
| 1323 | Ac-QHWSYGLRPG-NH2 | 1143 |
| 1324 | Ac-WQEWEQKIQHWSYGLRPGWASLWEWF-NH2 | 1144 |
| 1325 | Ac-WQEWEQKIQHWSYGLRPGWEWF-NH2 | 1145 |
| 1326 | Ac-WNWFQHWSYGLRPGWNWF-NH2 | 1146 |
| 1327 | Ac-FNFFQHWSYGLRPGFNFF-NH2 | 1147 |
| 1328 | Ac-GAGAQHWSYGLRPGAGAG-NH2 | 1148 |
| 1329 | PLLVLQAGFFLLTRILTIPQSLDSWWTSLNFLGGT | 482 |
| 1330 | Ac-WQEWEQKITALLEQAQIQQEKIEYELQKLAKWASLWEWF-NH2 | 1149 |
| 1331 | Ac-WQEWEQKITALLEQAQIQQEKIEYELQKLAEWASLWEWF-NH2 | 1150 |
| 1332 | Ac-WQEWEQKITALLEQAQIQQEKAEYELQKLAEWASLWEWF-NH2 | 1151 |
| 1333 | Ac-WQEWEQKITALLEQAQIQQEKAEYELQKLAEWASLWAWF-NH2 | 1152 |
| 1334 | Ac-WQEWEQKITALLEQAQIQQEKAEYELQKLAKWASLWAWF-NH2 | 1153 |
| 1335 | Ac-TNKAVVSLSNGVSVLTSKVLDLKNYIDKQLLPIVNK-NH2 | 1154 |
| 1336 | Ac-KAVVSLSNGVSVLTSKVLDLKNYIDKQLLPIVNKQS-NH2 | 1155 |
| 1337 | Ac-WQEWEQKITALLEQAQIQQEKNEYELQKLIEWEWF-NH2 | 1156 |
| 1338 | Ac-WQEWEQKITALLEQAQIQQEKNEYELQKLIEWEWF-NH2 | 1157 |
| 1339 | Ac-WQEWEQKITALLEQAQIQQEKIEYELQKLDKWEWF-NH2 | 1158 |
| 1340 | Ac-YDPLVFPSDEFDASISQVNEKINQSLAF-NH2 | 1159 |
| 1341 | Fluor--VYPSDEYDASISQVNEEINQALAYIRKADELLENV-NH2 | 1160 |
| 1342 | Fluor-YTSLIHSLIEESQNQQEKNEQELLELDKWASLWNWF-NH2 | 1161 |
| 1344 | Ac-SGIVQQQNNLLRAIEAQQHLLQLTVWGIKQLQARIL-NH2 | 1162 |
| 1345 | Ac-QQQNNLLRAIEAQQHLLQLTVWGIKQLQARILAVERYLKDQ-NH2 | 1163 |
| 1346 | Ac-SGIVQQQNNLLRAIEAQQHLLQLTVWGIKQLQARILAVERYLKDQ-NH2 | 1164 |
| 1347 | Ac-WQEWEQKITALLEQAQIQQEKNEYELQKLAEWASLWAWF-NH2 | 1165 |
| 1348 | Ac-WQEWEQKITALLEQAQIQQEKNEYELQKLAEWASLWAW-NH2 | 1166 |
| 1349 | Ac-WQEWEQKITALLEQAQIQQEKAEYELQKLAEWASLWAW-NH2 | 1167 |
| 1350 | Ac-WQEWEQKITALLEQAQIQQEKNEYELQKLAEWAGLWAWF-NH2 | 1168 |
| 1351 | Ac-WQEWEQKITALLEQAQIQQEKNEYELQKLAEWAGLWAW-NH2 | 1169 |
| 1352 | Ac-WQEWEQKITALLEQAQIQQEKAEYELQKLAEWAGLWAW-NH2 | 1170 |
| 1353 | Ac-WQEWEQKITALLEQAQIQQEKNEYELQKLDKWAGLWEWF-NH2 | 1171 |
| 1354 | Ac-WQEWQHWSYGLRPGWEWF-NH2 | 1172 |
| 1355 | Ac-WQAWQHWSYGLRPGWAWF-NH2 | 1173 |
| 1356 | Biotinyl-WQEWEQKITALLEQAQIQQEKNEYELQKLDKWASLWEWF-NH2 | 1174 |
| 1357 | WQEWEQKITALLEQAQIQQEKNEYELQKLDKWASLWEWF | 1175 |
| 1358 | WQEWEQKITALLEQAQIQQEKIEYELQKLIEWEWF | 1176 |
| 1361 | Ac-AGSTMGARSMTLTVQARQLLSGIVQQQNNLLRAIEAQQ-NH2 | 1179 |
| 1362 | Ac-AGSAMGAASLTLSAQSRTLLAGIVQQQQQLLDVVKRQQ-NH2 | 1180 |
| 1363 | Ac-AGSAMGAASTALTAQSRTLLAGIVQQQQQLLDVVKRQQ-NH2 | 1181 |
| 1364 | Ac-ALTAQSRTLLAGIVQQQQQLLDVVKRQQELLRLTVWGT-NH2 | 1182 |
| 1365 | Ac-TLSAQSRTLLAGIVQQQQQLLDVVKRQQEMLRLTVWGT-NH2 | 1183 |
| 1366 | Ac-TLTVQARQLLSGIVQQQNNLLRAIEAQQHLLQLTVWGI-NH2 | 1184 |
| 1367 | Ac-WQAWIEYEAELSQVKEKIEQSLAYIREADELWAWF-NH2 | 1185 |

| T No. | Sequence | Seq. ID No. |
|---|---|---|
| 1368 | Ac-WQAWIEYEASLSQAKEKIEESKAYIREADELWAWF-NH2 | 1186 |
| 1369 | Ac-WQAWIEYERLLVQAKLKIAIAKLYIAKELLEWAWF-NH2 | 1187 |
| 1370 | Ac-WQAWIEYERLLVQVKLKIAIALLYIAKELLEWAWF-NH2 | 1188 |
| 1371 | Ac-WQAWIELERLLVQVKLKLAIAKLEIAKELLEWAWF-NH2 | 1189 |
| 1372 | Ac-GEWTYDDATKTFTVTEGGH-NH2 | 1190 |
| 1373 | Ac-WQEWEQKIGEWTYDDATKTFTVTEGGHWASLWEWF-NH2 | 1191 |
| 1374 | Ac-GEWTYDDATKTFTVTE-NH2 | 1192 |
| 1375 | Ac-WQEWEQKIGEWTYDDATKTFTVTEWASLWEWF-NH2 | 1193 |
| 1376 | Ac-MHRFDYRT-NH2 | 1194 |
| 1377 | Ac-WQEWEQKIMHRFDYRTWASLWEWF-NH2 | 1195 |
| 1378 | Ac-MHRFNWSTGGG-NH2 | 1196 |
| 1379 | Ac-WQEWEQKIMHRFNWSTGGGWASLWEWF-NH2 | 1197 |
| 1380 | Ac-MHRFNWST-NH2 | 1198 |
| 1381 | Ac-WQEWEQKIMHRFNWSTWASLWEWF-NH2 | 1199 |
| 1382 | Ac-LLVPLARIMTMSSVHGGG-NH2 | 1200 |
| 1383 | Ac-WQEWEQKILLVPLARIMTMSSVHGGGWASLWEWF-NH2 | 1201 |
| 1384 | Ac-LLVPLARIMTMSSVH-NH2 | 1202 |
| 1385 | Ac-WQEWEQKILLVPLARIMTMSSVHWASLWEWF-NH2 | 1203 |
| 1386 | TALLEQAQIQQEKNEYELQKLDK | 1204 |
| 1387 | Ac-TALLEQAQIQQEKNEYELQKLDK-NH2 | 1205 |
| 1388 | Ac-TALLEQAQIQQEKIEYELQKLIE-NH2 | 1206 |
| 1389 | TALLEQAQIQQEKIEYELQKLIE | 1207 |
| 1390 | Ac-QARQLLSGIVQQQNNLLRAIEAQQHLLQLTVWGIKQLQARILAVERY-NH2 | 1208 |
| 1391 | Rhod-QARQLLSGIVQQQNNLLRAIEAQQHLLQLTVWGIKQLQARILAVERY-NH2 | 1209 |
| 1392 | Ac-GAASLTLSAQSRTLLAGIVQQQQQLLDVVKRQQEML-NH2 | 1210 |
| 1393 | Ac-GSAMGAASLTLSAQSRTLLAGIVQQQQQLLDVVKRQQEML-NH2 | 1211 |
| 1394 | Ac-PALSTGLIHLHQNIVDVQFLFGVGSSIASWAIKWEY-NH2 | 1212 |
| 1395 | Ac-PALSTGLIHLHQNIVDVQFLYGVGSSIASWAIK-NH2 | 1213 |
| 1396 | Ac-LSTTQWQVLPUSFTTLPALSTGLIHLHQNIVDVQY-NH2 | 1214 |
| 1397 | Ac-FRKFPEATFSRUGSGPRITPRUMVDFPFRLWHY-NH2 | 1215 |
| 1398 | Ac-DFPFRLWHFPUTINYTIFKVRLFVGGVEHRLEAAUNWTR-NH2♂ | 1216 |
| 1399 | Ac-YVGGVEHRLEAAUNWTRGERUDLEDRDRSELSPL-NH2 | 1217 |
| 1400 | MVYPSDEYDASISQVNEEINQALAYIRKADELLENV | 1218 |
| 1402 | Ac-GPLLVLQAGFFLLTRILTIPQSLDSWWTSLNFLGG-NH2 | 1220 |
| 1403 | Ac-LGPLLVLQAGFFLLTRILTIPQSLDSWWTSLNFLG-NH2 | 1221 |
| 1404 | Ac-FLGPLLVLQAGFFLLTRILTIPQSLDSWWTSLNFL-NH2 | 1222 |
| 1405 | Ac-YTNTIYTLLEESQNQQEKNEQELLELDKWASLWNWF-NH2 | 1223 |
| 1406 | YTNTIYTLLEESQNQQEKNEQELLELDKWASLWNWF | 1357 |
| 1407 | Ac-YTGIIYNLLEESQNQQEKNEQELLELDKWANLWNWF-NH2 | 1358 |
| 1408 | YTGIIYNLLEESQNQQEKNEQELLELDKWANLWNWF | 1359 |
| 1409 | Ac-YTSLIYSLLEKSQIQQEKNEQELLELDKWASLWNWF-NH2 | 1360 |
| 1410 | YTSLIYSLLEKSQIQQEKNEQELLELDKWASLWNWF | 1361 |
| 1411 | Ac-EKSQIQQEKNEQELLELDKWA-NH2 | 1362 |
| 1412 | EKSQIQQEKNEQELLELDKWA | 1363 |
| 1413 | Ac-EQAQIQQEKNEYELQKLDKWA-NH2 | 1364 |
| 1414 | Ac-YTSLIGSLIEESQIQQERNEQELLELDRWASLWEWF-NH2 | 1365 |
| 1415 | Ac-YTXLIHSLIXESQNQQXKNEQELXELDKWASLWNWF-NH2 | 1366 |
| 1416 | Ac-YTXLIHSLIWESQNQQXKNEQELXELD-NH2 | 1367 |
| 1417 | Ac-YTSLIHSLIEESQNQQEKNEQELLELD-NH2 | 1368 |
| 1418 | Ac-WQEQEXKITALLXQAQIQQXKNEYELXKLDKWASLWEWF-NH2 | 1369 |

| T No. | Sequence | Seq. ID No. |
|---|---|---|
| 1419 | Ac-XKITALLXQAQIQQXKNEYELXKLDKWASLWEWF-NH2 | 1370 |
| 1420 | Ac-WQEWWXKITALLXQAQIQQXKNEYELXKLD-NH2 | 1371 |
| 1421 | Ac-WEQKITALLEQAQIQQEKNEYELQKLD-NH2 | 1372 |
| 1422 | Ac-WEQXKITALLXQAQIQQXKNEYELXKLD-NH2 | 1373 |
| 1423 | Ac-XKITALLXQAQIQQXKNEYELXKLD-NH2 | 1374 |
| 1425 | Ac-QKITALLEQAQIQQEKNEYELQKLD-NH2 | 1375 |
| 1426 | Ac-QKITALLEQAQIQQEKNEYELQKLDKWASLWEWF-NH2 | 1381 |
| 1427 | Ac-WQEWEQKITALLEQAQIQQEKNEYELQKLD-NH2 | 1379 |
| 1428 | Ac-VYPSDEYDASISQVNEEINQALAYIRKADELLEN-OH | 1377 |
| 1429 | Ac-VYPSDEYDASISQVNEEINQALAYIRKADELLE-OH | 1380 |
| 1430 | Ac-VYPSDEYDASISQVNEEINQALAYIRKADELL-OH | 1376 |
| 1431 | Ac-VYPSDEYDASISQVNEEINQALAYIRKADEL-OH | 1378 |
| 1432 | YPSDEYDASISQVNEEINQALAYIRKADELLENV-NH2 | 1227 |
| 1433 | PSDEYDASISQVNEEINQALAYIRKADELLENV-NH2 | 1228 |
| 1434 | SDEYDASISQVNEEINQALAYIRKADELLENV-NH2 | 1229 |
| 1435 | DEYDASISQVNEEINQALAYIRKADELLENV-NH2 | 1230 |
| 1436 | Ac-VYPSDEYDASISQVDEEINQALAYIRKADELLENV-NH2 | 1231 |
| 1437 | Ac-VYPSDEYDASISQVNEEIDQALAYIRKADELLENV-NH2 | 1232 |
| 1438 | Ac-VYPSDEYDASISQVNEEINQALAYIRKADELLEDV-NH2 | 1233 |
| 1439 | Ac-VYPSDEYDASISQVDEEIDQALAYIRKADELLENV-NH2 | 1234 |
| 1440 | Ac-LLSTNKAVVSLSNGVSVLTSKVLDLKNYIDKQLLP-NH2 | 1235 |
| 1441 | Ac-LSTNKAVVSLSNGVSVLTSKVLDLKNYIDKQLLPI-NH2 | 1236 |
| 1442 | Ac-STNKAVVSLSNGVSVLTSKVLDLKNYIDKQLLPIV-NH2 | 1382 |
| 1443 | Ac-TNKAVVSLSNGVSVLTSKVLDLKNYIDKQLLPIVN-NH2 | 1383 |
| 1444 | Ac-NKAVVSLSNGVSVLTSKVLDLKNYIDKQLLPIVNK-NH2 | 1384 |
| 1445 | Ac-KAVVSLSNGVSVLTSKVLDLKNYIDKQLLPIVNKQ-NH2 | 1385 |
| 1446 | Ac-AVVSLSNGVSVLTSKVLDLKNYIDKQLLPIVNKQS-NH2 | 1386 |
| 1447 | Ac-VVSLSNGVSVLTSKVLDLKNYIDKQWLLPIVNKQSU-NH2 | 1387 |
| 1448 | Ac-VSLSNGVSVLTSKVLDLKNYIDKQLLPIVNKQSUS-NH2 | 1388 |
| 1449 | Ac-SLSNGVSVLTSKVLDLKNYIDKQLLPIVNKQSUSI-NH2 | 13389 |
| 1450 | Ac-LSNGVSVLTSKVLDLKNYIDKQLLPIVNKQSUSIS-NH2 | 1390 |
| 1451 | Ac-SNGVSVLTSKVLDLKNYIDKQLLPIVNKQSUSISN-NH2 | 1391 |
| 1452 | Ac-NGVSVLTSKVLDLKNYIDKQLLPIVNKQSUSISNI-NH2 | 1392 |
| 1453 | Ac-GVSVLTSKVLDLKNYIDKQLLPIVNKQSUSISNIE-NH2 | 1393 |
| 1454 | Ac-VSVLTSKVLDLKNYIDKQLLPIVNKQSUSISNIET-NH2 | 1394 |
| 1455 | Ac-SVLTSKVLDLKNYIDKQLLPIVNKQSUSISNIETV-NH2 | 1395 |
| 1456 | Ac-VLTSKVLDLKNYIDKQLLPIVNKQSUSISNIETVI-NH2 | 1396 |
| 1457 | Ac-LTSKVLDLKNYIDKQLLPIVNKQSUSISNIETVIE-NH2 | 1397 |
| 1458 | Ac-TSKVLDLKNYIDKQLLPIVKQSUSISNIETVIEF-NH2 | 1398 |
| 1459 | Ac-SKVLDLKNYIDKQLLPIVNKQSUSISNIETVIEFQ-NH2 | 1399 |
| 1460 | Ac-KVLDLKNYIDKQLLPIVNKQSUSISNIETVIEFQQ-NH2 | 1400 |
| 1461 | Ac-VLDLKNYIDKQLLPIVNKQSUSISNIETVIEFQQK-NH2 | 1401 |
| 1462 | Ac-LDLKNYIDKQLLPIVNKQSUSISNIETVIEFQQKN-NH2 | 1402 |
| 1463 | Ac-DLKNYIDKQLLPIVNKQSUSISNIETVIEFQQKNN-NH2 | 1403 |
| 1464 | Ac-LKNYIDKQLLPIVNKQSUSISNIETVIEFQQKNNR-NH2 | 1404 |
| 1465 | Ac-KNYIDKQLLPIVNKQSUSISNIETVIEFQQKNNRL-NH2 | 1405 |
| 1466 | Ac-NYIDKQLLPIVNKQSUSISNIETVIEFQQKNNRLL-NH2 | 1406 |
| 1467 | Ac-YIDKQLLPIVNKQSUSISNIETVIEFQQKNNRLLE-NH2 | 1407 |
| 1468 | Ac-IDKQLLPIVNKQSUSISNIETVIEFQQKNNRLLEI-NH2 | 1408 |
| 1469 | Ac-DKQLLPIVNKQSUSISNIETVIEFQQKNNRLLEIT-NH2 | 1409 |

| T No. | Sequence | Seq. ID No. |
|---|---|---|
| 1470 | Ac-KQLLPIVNKQSUSISNIETVIEFQQKNNRLLEITR-NH2 | 1410 |
| 1471 | Ac-QLLPIVNKQSUSISNIETVIEFQQKNNRLLEITRE-NH2 | 1411 |
| 1472 | Ac-VYPSDEYDASISQVNEEINQALA | 1412 |
| 1473 | QVNEEINQALAYIRKADELLENV-NH2 | 1413 |
| 1474 | VYPSDEYDASISQVNEEINQALAYIRKADELLENV | 1414 |
| 1475 | Ac-DEYDASISQVNEEINQALAYIREADEL-NH2 | 1415 |
| 1476 | Ac-DEYDASISQVNEKINQALAYIREADEL-NH2 | 1416 |
| 1477 | Ac-DDECLNSVKNGTYDFPKFEEESKLNRNEIKGVKLS-NH2 | 1417 |
| 1478 | Ac-DDE-Abu-LNSVKNGTYDFPKFEEESKLNRNEIKGVKLS-NH2 | 1718 |
| 1479 | Ac-YHKCDDECLNSVKNGTFDFPKFEEESKLNRNEIKGVKLSS-NH2 | 1719 |
| 1480 | Ac-YHK-Abu-DDE-Abu-LNSVKNGTFDFPKFEEESKLNRNEIKGVKLSS-NH2 | 1420 |
| 1481 | Ac-YTSLIHSLIEESQIQQEKNEQELLELDKWASLWNWF-NH2 | 1344 |
| 1482 | Ac-YTSLIHSLIEESQNQQEKNEYELLELDKWASLWNWF-NH2 | 1345 |
| 1483 | Ac-YTSLIHSLIEESQIQQEKNEYELLELDKWASLWNWF-NH2 | 1346 |
| 1484 | Ac-YTSLIHSLIEESQIQQEKNEYELQKLDKWASLWNWF-NH2 | 1347 |
| 1485 | Ac-YTSLIHSLIEESQNQQEKNEQELQKLDKWASLWNWF-NH2 | 1348 |
| 1486 | Ac-YTSLIHSLIEESQNQQEKNEYELQKLDKWASLWNWF-NH2 | 1421 |
| 1487 | Ac-YTSLIHSLIEESQIQQEKNEQELQKLDKWASLWNWF-NH2 | 1422 |
| 1488 | Ac-YTSLIHSLIEESQNQQEKNEQELLELDKWASLWEWF-NH2 | 1423 |
| 1489 | Ac-YTSLIHSLIEESQIQQEKNEQELLELDKWASLWEWF-NH2 | 1424 |
| 1490 | Ac-YTSLIHSLIEESQNQQEKNEYELLELDKWASLWEWF-NH2 | 1425 |
| 1491 | Ac-YTSLIHSLIEESQIQQEKNEYELLELDKWASLWEWF-NH2 | 1426 |
| 1492 | Ac-YTSLIHSLIEESQIQQEKNEYELQKLDKWASLWEWF-NH2 | 1427 |
| 1493 | Ac-YTSLIHSLIEESQNQQEKNEQELQKLDKWASLWEWF-NH2 | 1428 |
| 1494 | Ac-YTSLIHSLIEESQNQQEKNEYELQKLDKWASLWEWF-NH2 | 1429 |
| 1495 | Ac-YTSLIHSLIEESQIQQEKNEQELQKLDKWASLWEWF-NH2 | 1430 |
| 1496 | Ac-WQEQEQKITALLEQAQIQQEKNEYELQKLDKEWWF-NH2 | 1431 |
| 1497 | Ac-WQEWEQKITALLEQAQIQQEKNEYELQKLIEWASLWEWF-NH2 | 1432 |
| 1498 | Ac-WQEWEQKITALLEQAQIQQEKNEYELQKLAKWASLWEWF-NH2 | 1256 |
| 1499 | Ac-WQEWEQKITALLEQAQIQQEKNEYELQKLIKWASLWEWF-NH2 | 1257 |
| 1500 | Ac-WQEWEQKITALLEQAQIQQEKNEYELQKLIEWAGLWEWF-NH2 | 1258 |
| 1501 | Ac-WQEWEQKITALLEQAQIQQEKNEYELQKLAKWAGLWEWF-NH2 | 1259 |
| 1502 | Ac-WQEWEQKITALLEQAQIQQEKNEYELQKLIKWAGLWEWF-NH2 | 1260 |
| 1503 | Ac-WQEWEQKITALLEQAQIQQEKNEYELQKLIEWAGLWAWF-NH2 | 1261 |
| 1504 | Ac-WQEWEQKITALLEQAQIQQEKNEYELQKLAKWAGLWAWF-NH2 | 1262 |
| 1505 | Ac-WQEWEQKITALLEQAQIQQEKNEYELQKLIKWAGLWAWF-NH2 | 1263 |
| 1506 | Ac-WQEWEQKITALLEQAQIQQEKGEYELQKLDKQEQF-NH2 | 1264 |
| 1507 | Ac-WQEWEQKITALLEQAQIQQEKGEYELLELDKWEWF-NH2 | 1265 |
| 1508 | Ac-WQEWEQKITALLEQAQIQQEKGEYELQKLAKWEWF-NH2 | 1266 |
| 1509 | Ac-WQEWEQKITALLEQAQIQQEKGEYELQKLDWQWEF-NH2 | 1267 |
| 1510 | Ac-WQEWEQKITALLEQAQIQQEKGEYELLELAKWEWF-NH2 | 1268 |
| 1511 | Ac-WEQWEQKITALLEQAQIQQEKNEYELLELDKWEWF-NH2 | 1269 |
| 1512 | Ac-WQEWEQKITALLEQAQIQQEKNEYELEEELIEWASLWEWF-NH2 | 1270 |
| 1513 | Ac-WQEWEQKITALLEQAQIQQEKNEYELLELIEWAGLWEWF-NH2 | 1271 |
| 1514 | Ac-WQEWEQKITALLEQAQIQQEKNEYELLELIEWAGLWAWF-NH2 | 1272 |
| 1515 | Ac-WQEWEREITALLEQAQIQQEKNEYELQKLIEWASLWEWF-NH2 | 1273 |
| 1516 | Ac-WQEWEREIQQEKNEYELQKLDKWASLWEWF-NH2 | 1274 |
| 1517 | Ac-WQEWEREIQQEKGEYELQKLIEWEWF-NH2 | 1275 |
| 1518 | Ac-WQEWQAQIQQEKNEYELQKLDKWASLWEWF-NH2 | 1276 |
| 1519 | Ac-WQEWQAQIQQEKGEYELQKLIEWEWF-NH2 | 1277 |

| T No. | Sequence | Seq. ID No. |
|---|---|---|
| 1520 | PEG-GWQEWEQRITALLEQAQIQQERNEYELQRLDEWASLWEWF-NH2 | 1437 |
| 1521 | Ac-GWQEWEQRITALLEQAQIQQERNEYELQRLDEWASLWEWF-NH2 | 1438 |
| 1522 | PEG-YTSLITALLEQAQIQQERNEQELLELDEWASLWEWF-NH2 | 1439 |
| 1523 | Ac-YTSLITALLEQAQIQQERNEQELLELDEWASLWEWF-NH2 | 1440 |
| 1526 | PEG-GWQEWEQRITALLEQAQIQQERNEYELQELDEWASLWEWF-NH2 | 1441 |
| 1527 | Ac-GWQEWEQRITALLEQAQIQQERNEYELQELDEWASLWEWF-NH2 | 1442 |
| 1528 | PEG-YTSLIGSLIEESQIQQERNEQELLELDRWASLWEWF-NH2 | 1443 |
| 1529 | PEG-GWQEWEQRITALLEQAQIQQERNEYELQRLDRWASLWEWF-NH2 | 1444 |
| 1530 | Ac-GWQEWEQRITALLEQAQIQQERNEYELQRLDRWASLWEWF-NH2 | 1445 |
| 1531 | PEG-GWQEWEQRITALLEQAQIQQERNEYELQELDRWASLWEWF-NH2 | 1446 |
| 1532 | Ac-GWQEWEQRITALLEQAQIQQERNEYELQELDRWASLWEWF-NH2 | 1447 |
| 1533 | PEG-YTSLIGSLIEESQNQQERNEQELLELDRWASLWNWF-NH2 | 1448 |
| 1534 | Ac-YTSLIGSLIEESQNQQERNEQELLELDRWASLWNWF-NH2 | 1449 |
| 1538 | Ac-YTSLIHSLIEESQNQQEK-OH | 1450 |
| 1539 | NEQELLELDK | 1451 |
| 1540 | WASLWNWF-NH2 | 1452 |
| 1542 | Ac-AAAWEQKITALLEQAQIQQEKNEYELQKLDKWASLWEWF-NH2 | 1453 |
| 1543 | Ac-WQEAAAKITALLEQAQIQQEKNEYELQKLDKWASLWEWF-NH2 | 1454 |
| 1544 | Ac-WQEWEQAAAALLEQAQIQQEKNEYELQKLDKWASLWEWF-NH2 | 1455 |
| 1545 | Ac-WQEWEQKITAAAEQAQIQQEKNEYELQKLDKWASLWEWF-NH2 | 1456 |
| 1546 | Ac-WQEWEQKITALLAAAQIQQEKNEYELQKLDKWASLWEWF-NH2 | 1457 |
| 1547 | Ac-WQEWEQKITALLEQAAAAQEKNEYELQKLDKWASLWEWF-NH2 | 1458 |
| 1548 | Ac-WQEWEQKITALLEQAQIQAAANEYELQKLDKWASLWEWF-NH2 | 1459 |
| 1549 | Ac-WQEWEQKITALLEQAQIQQEKAAAELQKLDKWASLWEWF-NH2 | 1460 |
| 1550 | Ac-WQEWEQKITALLEQAQIQQEKNEYAAAKLDKWASLWEWF-NH2 | 1461 |
| 1551 | Ac-WQEWEQKITALLEQAQIQQEKNEYELQAAAKWASLWEWF-NH2 | 1462 |
| 1552 | Ac-WQEWEQKITALLEQAQIQQEKNEYELQKLDAAASLWEWF-NH | 1463 |
| 1553 | Ac-WQEWEQKITALLEQAQIQQEKNEYELQKLDKWAAAAEWF-NH | 1464 |
| 1554 | Ac-WQEWEQKITALLEQAQIQQEKNEYELQKLDKWASLWAAA-NH | 1465 |
| 1556 | Ac-YTSLIHSLIEESQNQQEKNEQELLLDKWASLWNWF-NH2 | 1466 |
| 1557 | Ac-YTSLIHSLIEESQNQEKNEQELLELDKWASLWNWF-NH2 | 1467 |
| 1558 | Ac-ERTLDFHDS-NH2 | 1468 |
| 1559 | Ac-YTSLIHSLIEESQNQQEKNEQELLELDKWASLWN(W)F-NH2 | 1469 |
| 1563 | Ac-YTSLIHSLIEESQN(Q)QEKNEQELLELDKWASLWNWF-NH2 | 1470 |
| 1564 | Ac-YTSLIHSLIEESQNQQDKWASLWNWF-NH2 | 1471 |
| 1566 | Ac-FYEIIMDIEQNNVQGKKGIQQLQKWEDWVGWIGNI-NH2 | 1472 |
| 1567 | Ac-INQTIWNHGNITLGEWYNQTKDLQQKFYEIIMDIE-NH2 | 1473 |
| 1568 | Ac-WNHGNITLGEWYNQTKDLQQKFYEIIMDIEQNNVQ-NH2 | 1474 |
| 1572 | Ac-YTSLIHSLIEESENQQEKNEQELLELDKWASLWNWF-NH2 | 1475 |
| 1573 | Ac-YTSLIHSLIEESQDQQEKNEQELLELDKWASLWNWF-NH2 | 1476 |
| 1574 | Ac-YTSLIHSLIEESQNEQEKNEQELLELDKWASLWNWF-NH2 | 1477 |
| 1575 | c-YTSLIHSLIEESQNQEEKNEQELLELDKWASLWNWF-NH2 | 1478 |
| 1576 | Ac-YTSLIHSLIEESQNQQEKDEQELLELDKWASLWNWF-NH2 | 1479 |
| 1577 | Ac-LGEWYNQTKDLQQKFYEIIMDIEQNNVQGKKGIQQ-NH2 | 1480 |
| 1578 | Ac-WYNQTKDLQQKFYEIIMDIEQNNVQGKKGIQQLQK-NH2 | 1481 |
| 1579 | Ac-YTSLIHSLIEESQNQQEKNEEELLELDKWASLWNWF-NH2 | 1482 |
| 1580 | Ac-YTSLIHSLIEESQNQQEKNEQELLELDKWASLWDWF-NH2 | 1483 |
| 1586 | Ac-XTSLIHSLIEESQNQQEKNEQELLELDKWASLWNWX-NH2 | 1484 |
| 1588 | Ac-YNQTKDLQQKFYEIIMDIEQNNVQGKKGIQQLQKW-NH2 | 1485 |
| 1598 | Ac-YTSLIHSLIEESQNQQEKNEQELLELDKWASLWNWF | 1486 |

| T No. | Sequence | Seq. ID No. |
|---|---|---|
| 1600 | Ac-TLTVQARQLLSGIVQQQNNLLRAIEAQQHLLQLTVWGIKQLQAR-NH2 | 1487 |
| 1603 | Ac-LQQKFYEIIMDIEQNNVQGKKGIQQLQKWEDWVGW-NH2 | 1488 |
| 1627 | Ac-YTSLIHSLIEESQNQQEKNEQELLALDKWASLWNWF-NH2 | 1489 |
| 1628 | Ac-YTSLIHSLIEESQNQQEKNEQELLEADKWASLWNWF-NH2 | 1490 |
| 1629 | Ac-YTSLIHSLIEESQNQQEKNEQELLELAKWASLWNWF-NH2 | 1491 |
| 1630 | Ac-YTSLIHSLIEESQNQQEKAEQELLELDKWASLWNWF-NH2 | 1492 |
| 1631 | Ac-YTSLIHSLIEESQNQQEKNAQELLELDKWASLWNWF-NH2 | 1493 |
| 1632 | Ac-YTSLIHSLIEESQNQQEKNEAELLELDKWASLWNWF-NH2 | 1494 |
| 1634 | Ac-WQEWEQKITALLEQAQIQQEKNEQELQKLDKWASLWEWF-NH2 | 1495 |
| 1635 | Ac-WQEWEQKITALLEQAQIQQEKAEYELQKLDKWASLWEWF-NH2 | 1496 |
| 1636 | Ac-WQEWEQKITALLEQAQIQQEKNAYELQKLDKWASLWEWF-NH2 | 1497 |
| 1637 | Ac-WQEWEQKITALLEQAQIQQEKNEAELQKLDKWASLWEWF-NH2 | 1498 |
| 1644 | Ac-EYDLRRWEK-NH2 | 1499 |
| 1645 | Ac-EQELLELDK-NH2 | 1500 |
| 1646 | Ac-EYELQKLDK-NH2 | 1501 |
| 1647 | Ac-WQEWEQKITALLEQAQIQQEKNEQELLKLDKWASLWEWF-NH2 | 1502 |
| 1648 | Ac-WQEWEQKITALLEQAQIQQEKNEQELLELDKWASLWEWF-NH2 | 1503 |
| 1649 | Ac-WQEWEQKITALLEQAQIQQEKNDKWASLWEWF-NH2 | 1504 |
| 1650 | Ac-YTSLIHSLIEESQNQAEKNEQELLELDKWASLWNWF-NH2 | 1505 |
| 1651 | Ac-YTSLIHSLIEESQNQQAKNEQELLELDKWASLWNWF-NH2 | 1506 |
| 1652 | Ac-YTSLIHSLIEESQNQQEANEQELLELDKWASLWNWF-NH2 | 1507 |
| 1653 | Ac-YTSLIHSLIEESANQQEANEQELLELDKWASLWNWF-NH2 | 1508 |
| 1654 | Ac-YTSLIHSLIEESQAQQEKNEQELLELDKWASLWNWF-NH2 | 1509 |
| 1655 | Ac-YTSLIHSLIEESQNAQEKNEQELLELDKWASLWNWF-NH2 | 1510 |
| 1656 | Ac-YTSLIHALIEESQNQQEKNEQELLELDKWASLWNWF-NH2 | 1511 |
| 1657 | Ac-YTSLIHSAIEESQNQQEKNEQELLELDKWASLWNWF-NH2 | 1512 |
| 1658 | Ac-VYPSDEYDASISQVNEEINQALAYIRKADELLENV-NH2 | 1513 |
| 1659 | Ac-YTSLIHSLAEESQNQQEKNEQELLELDKWASLWNWF-NH2 | 1514 |
| 1660 | Ac-YTSAIHSLIEESQNQQEKNEQELLELDKWASLWNWF-NH2 | 1515 |
| 1661 | Ac-YTSLAHSLIEESQNQQEKNEQELLELDKWASLWNWF-NH2 | 1516 |
| 1662 | Ac-YTSLIASLIEESQNQQEKNEQELLELDKWASLWNWF-NH2 | 1517 |
| 1663 | Ac-ATSLIHSLIEESQNQQEKNEQELLELDKWASLWNWF-NH2 | 1518 |
| 1664 | Ac-YASLIHSLIEESQNQQEKNEQELLELDKWASLWNWF-NH2 | 1519 |
| 1665 | Ac-YTALIHSLIEESQNQQEKNEQELLELDKWASLWNWF-NH2 | 1520 |
| 1666 | Ac-RIQDLEKYVEDTKIDLWSYNAELLVALENQ-NH2 | 1521 |
| 1667 | Ac-HTIDLTDSEMNKLFEKTRRQLREN-NH2 | 1522 |
| 1668 | Ac-SEMNKLFEKTRRQLREN-NH2 | 1523 |
| 1669 | Ac-VFPSDEADASISQVNEKINQSLAFIRKSDELLHNV-NH2 | 1524 |
| 1670 | Ac-VFPSDEFAASISQVNEKINQSLAFIRKSDELLHNV-NH2 | 1525 |
| 1671 | Ac-VFPSDEFDASISAVNEKINQSLAFIRKSDELLHNV-NH2 | 1526 |
| 1672 | Ac-VFPSDEFDASISQANEKINQSLAFIRKSDELLHNV-NH2 | 1527 |
| 1673 | Ac-VFPSDEFDASISQVAEKINQSLAFIRKSDELLHNV-NH2 | 1528 |
| 1674 | Ac-WQEWEQKITAALEQAQIQQEKNEYELQKLDKWASLWEWF-NH2 | 1529 |
| 1675 | Ac-WQEWEQKITALAEQAQIQQEKNEYELQKLDKWASLWEWF-NH2 | 1530 |
| 1676 | Ac-WQEWEQKITALLEQAAIQQEKNEYELQKLDKWASLWEWF-NH2 | 1531 |
| 1677 | Ac-WQEWEQKITALLEQAQAQQEKNEYELQKLDKWASLWEWF-NH2 | 1532 |
| 1678 | Ac-WQEWEQKITALLEQAQIAQEKNEYELQKLDKWASLWEWF-NH2 | 1533 |
| 1679 | Ac-WQEWEQKITALLEQAQIQAEKNEYELQKLDKWASLWEWF-NH2 | 1534 |
| 1680 | Ac-VFPSDEFDASISQVNEKINQSAAFIRKSDELLHNV-NH2 | 1535 |
| 1681 | Ac-VFPSDEFDASISQVNEKINQSLAAIRKSDELLHNV-NH2 | 1536 |

| T No. | Sequence | Seq. ID No. |
|---|---|---|
| 1682 | Ac-VFPSDEFDASISQVNEKINQSLAFIRKSDEALHNV-NH2 | 1537 |
| 1683 | Ac-VFPSDEFDASISQVNEKINQSLAFIRKSDELAHNV-NH2 | 1539 |
| 1684 | Ac-VFPSDEFDASISQVNEKINQSLAFIRKSDELLANV-NH2 | 1539 |
| 1685 | Ac-WQEWEQKITALLEQAQIQQAKNEYELQKLDKWASLWEWF-NH2 | 1540 |
| 1687 | Ac-WQEWEQKITALLEQAQIQQEKNEYELQALDKWASLWEWF-NH2 | 1541 |
| 1688 | Ac-WQEWEQKITALLEQAQIQQEKNEYELQKADKWASLWEWF-NH2 | 1542 |

5.4. Synthesis of Peptides

The peptides of the invention may be synthesized or prepared by techniques well known in the art. See, for example, Creighton, 1983, Proteins: Structures and Molecular Principles, W. H. Freeman and Co., NY, which is incorporated herein by reference in its entirety. Short peptides, for example, can be synthesized on a solid support or in solution. Longer peptides may be made using recombinant DNA techniques. Here, the nucleotide sequences encoding the peptides of the invention may be synthesized, and/or cloned, and expressed according to techniques well known to those of ordinary skill in the art. See, for example, Sambrook, et al., 1989, Molecular Cloning, A Laboratory Manual, Vols. 1–3, Cold Spring Harbor Press, NY.

The peptides of the invention may alternatively be synthesized such that one or more of the bonds which link the amino acid residues of the peptides are non-peptide bonds. These alternative non-peptide bonds may be formed by utilizing reactions well known to those in the art, and may include, but are not limited to imino, ester, hydrazide, semicarbazide, and azo bonds, to name but a few. In yet another embodiment of the invention, peptides comprising the sequences described above may be synthesized with additional chemical groups present at their amino and/or carboxy termini, such that, for example, the stability, bioavailability, and/or inhibitory activity of the peptides is enhanced. For example, hydrophobic groups such as carbobenzoxyl, dansyl, or t-butyloxycarbonyl groups, may be added to the peptides' amino termini. Likewise, an acetyl group or a 9-fluorenylmethoxy-carbonyl group may be placed at the peptides' amino termini. (See "X" Tables I to IV, above.) Additionally, the hydrophobic group, t-butyloxycarbonyl, or an amido group may be added to the peptides' carboxy termini. (See "Z" in Tables I to IV, above.)

Further, the peptides of the invention may be synthesized such that their steric configuration is altered. For example, the D-isomer of one or more of the amino acid residues of the peptide may be used, rather than the usual L-isomer.

Still further, at least one of the amino acid residues of the peptides of the invention may be substituted by one of the well known non-naturally occurring amino acid residues. Alterations such as these may serve to increase the stability, bioavailability and/or inhibitory action of the peptides of the invention.

Any of the peptides described above may, additionally, have a macromolecular carrier group covalently attached to their amino and/or carboxy termini. Such macromolecular carrier groups may include, for example, lipid-fatty acid conjugates, polyethylene glycol, carbohydrates or additional peptides. "X", in Tables I to IV, above, may therefore additionally represent any of the above macromolecular carrier groups covalently attached to the amino terminus of a peptide, with an additional peptide group being preferred. Likewise, "Z", in Tables I to IV, may additionally represent any of the macromolecular carrier groups described above.

5.5 Assays for Anti-Membrane Fusion Activity

Described herein, are methods for ability of a compound, such as the peptides of the invention, to inhibit membrane fusion events. Specifically, assays for cell fusion events are described in Section 5.5.1, below, and assays for antiviral activity are described in Section 5.5.2, below.

5.5.1 Assays for Cell Fusion Events

Assays for cell fusion events are well known to those of skill in the art, and may be used in conjunction, for example, with the peptide of the invention to test the peptides' antifusogenic capabilities.

Cell fusion assays are generally performed in vitro. Such an assay may comprise culturing cells which, in the absence of any treatment would undergo an observable level of syncytial formation. For example, uninfected cells may be incubated in the presence of cells chronically infected with a virus that induces cell fusion. Such viruses may include, but are not limited to, HIV, SIV, or respiratory syncytial virus.

For the assay, cells are incubated in the presence of a peptide to be assayed. For each peptide, a range of peptide concentrations may be tested. This range should include a control culture wherein no peptide has been added.

Standard conditions for culturing cells, well known to those of ordinary skill in the art, are used. After incubation for an appropriate period (24 hours at 37° C., for example) the culture is examined microscopically for the presence of multinucleated giant cells, which are indicative of cell fusion and syncytial formation. Well known stains, such as crystal violet stain, may be used to facilitate the visualization of syncytial formation.

5.5.2 Assays for Antiviral Activity

The antiviral activity exhibited by the peptides of the invention may be measured, for example, by easily performed in vitro assays, such as those described below, which can test the peptides' ability to inhibit syncytia formation, or their ability to inhibit infection by cell-free virus. Using three assays, such parameters as the relative antiviral activity of the peptides, exhibit against a given strain of virus and/or the strain specific inhibitory activity of the peptide can be determined.

A cell fusion assay may be utilized to test the peptides' ability to inhibit viral-induced, such as HIV-induced, syncytia formation in vitro. Such an assay may comprise culturing uninfected cells in the presence of cells chronically infected with a syncytial-inducing virus and a peptide to be assayed. For each peptide, a range of peptide concentrations may be treated. This range should include a control culture wherein no peptide has been added. Standard conditions for culturing, well known to those of ordinary skill in the art, are used. After incubation for an appropriate period (24 hours at 37° C., for example) the culture is examined microscopically for the presence of multinucleated giant cells, which are indicative of cell fusion and syncytia formation. Well known stains, such as crystal violet stain, may be used to facilitate syncytial visualization. Taking HIV as an example, such an assay would comprise CD-4$^+$ cells (such as Molt or CEM cells, for example) cultured in the presence of chronically HIV-infected cells and a peptide to be assayed.

Other well known characteristics of viral infection may also be assayed to test a peptide's antiviral capabilities. Once again taking HIV as an example, a reverse transcriptase (RT) assay may be utilized to test the peptides' ability to inhibit infection of CD-4$^+$ cells by cell-free HIV. Such an assay may comprise culturing an appropriate concentration (i.e., TCID$_{50}$) of virus and CD-4$^+$ cells in the presence of the peptide to be tested. Culture conditions well known to those in the art are used. As above, a range of peptide concentrations may be used, in addition to a control culture wherein no peptide has been added. After incubation for an appropriate period (e.g., 7 days) of culturing, a cell-free supernatant is prepared, using standard procedures, and tested for the present of RT activity as a measure of successful infection. The RT activity may be tested using standard techniques such as those described by, for example, Goff et al. (Goff, S. et al., 1981, J. Virol. 38:239–248) and/or Willey et al. (Willey, R. et al., 1988, J. Virol. 62:139–147). These references are incorporated herein by reference in their entirety.

Standard methods which are well-known to those of skill in the art may be utilized for assaying non-retroviral activity. See, for example, Pringle et al. (Pringle, C. R. et al., 1985, J. Medical Virology 17:377–386) for a discussion of respiratory syncytial virus and parainfluenza virus activity assay techniques. Further, see, for example, "Zinsser Microbiology", 1988, Joklik, W. K. et al., eds., Appleton & Lange, Norwalk, Conn., 19th ed., for a general review of such techniques. These references are incorporated by reference herein in their entirety. In addition, the Examples presented below, in Sections 17, 18, 26 and 27 each provide additional assays for the testing of a compound's antiviral capability.

In vivo assays may also be utilized to test, for example, the antiviral activity of the peptides of the invention. To test for anti-HIV activity, for example, the in vivo model described in Barnett et al. (Barnett, S. W. et al., 1994, Science 266:642–646) may be used.

Additionally, anti-RSV activity can be assayed in vivo via well known mouse models. For example, RSV can be administered intranasally to mice of various inbred strains. Virus replicates in lungs of all strains, but the highest titers are obtained in P/N, C57L/N and DBA/2N mice. Infection of BALB/c mice produces an asymptomatic bronchiolitis characterized by lymphocytic infiltrates and pulmonary virus titers of $10^4$ to $10^5$ pfu/g of lung tissue (Taylor, G. et al., 1984, Infect. Immun. 43:649–655).

Cotton rat models of RSV are also well known. Virus replicates to high titer in the nose and lungs of the cotton rat but produces few if any signs of inflammation.

5.6 Uses of the Peptides of the Invention

The peptides of the invention may be utilized as antifusogenic or antiviral compounds, or as compounds which modulate intracellular processes involving coiled coil peptide structures. Further, such peptides may be used to identify agents which exhibit antifusogenic, antiviral or intracellular modulatory activity. Still further, the peptides of the invention may be utilized as organism or viral type/subtype-specific diagnostic tools.

The antifusogenic capability of the peptides of the invention may additionally be utilized to inhibit or treat/ameliorate symptoms caused by processes involving membrane fusion events. Such events may include, for example, virus transmission via cell—cell fusions, abnormal neurotransmitter exchange via cell-fusion, and sperm-egg fusion. Further, the peptides of the invention may be used to inhibit free viral, such as retroviral, particularly HIV, transmission to uninfected cells wherein such viral infection involves membrane fusion events or involves fusion of a viral structure with a cell membrane. Among the intracellular disorders involving coiled coil peptides structures which may be ameliorated by the peptides of the invention are disorders involving, for example, bacterial toxins.

With respect to antiviral activity, the viruses whose transmission may be inhibited by the peptides of the invention include, but are not limited to human retroviruses, such as HIV-1 and HIV-2 and the human T-lymphocyte viruses (HTLV-I and II), and non-human retroviruses such as bovine leukosis virus, feline sarcoma and leukemia viruses, simian immunodeficiency, sarcoma and leukemia viruses, and sheep progress pneumonia viruses.

Non-retroviral viruses whose transmission may be inhibited by the peptides of the invention include, but are not limited to human respiratory syncytial virus, canine distemper virus, newcastle disease virus, human parainfluenza virus, influenza viruses, measles viruses, Epstein-Barr viruses, hepatitis B viruses, and simian Mason-Pfizer viruses.

Non enveloped viruses whose transmission may be inhibited by the peptides of the invention include, but are not limited to picornaviruses such as polio viruses, hepatitis A virus, enterovirus, echoviruses and coxsackie viruses, papovaviruses such as papilloma virus, parvoviruses, adenoviruses and reoviruses.

As discussed more fully, below, in Section 5.6.1 and in the Example presented, below, in Section 8, DP107, DP178, DP107 analog and DP178 analog peptides form non-covalent protein—protein interactions which are required for normal activity of the virus. Thus, the peptides of the invention may also be utilized as components in assays for the identification of compounds that interfere with such protein—protein interactions and may, therefore, act as antiviral agents. These assays are discussed, below, in Section 5.6.1.

As demonstrated in the Example presented below in Section 6, the antiviral activity of the peptides of the invention may show a pronounced type and subtype specificity, i.e., specific peptides may be effective in inhibiting the activity of only specific viruses. This feature of the invention presents many advantages. One such advantage, for example, lies in the field of diagnostics, wherein one can use the antiviral specificity of the peptide of the invention to ascertain the identity of a viral isolate. With respect to HIV, one may easily determine whether a viral isolate consists of an HIV-1 or HIV-2 strain. For example, uninfected CD-4$^+$ cells may be co-infected with an isolate which has been identified as containing HIV the DP178 (SEQ ID:1) peptide, after which the retroviral activity of cell supernatants may be assayed, using, for example, the techniques described above in Section 5.2. Those isolates whose retroviral activity is completely or nearly completely inhibited contain HIV-1. Those isolates whose viral activity is unchanged or only reduced by a small amount, may be considered to not contain HIV-1. Such an isolate may then be treated with one or more of the other DP178 peptides of the invention, and subsequently be tested for its viral activity in order to determine the identify of the viral isolate. The DP107 and DP178 analogs of the invention may also be utilized in a diagnostic capacity specific to the type and subtype of virus or organism in which the specific peptide sequence is found. A diagnostic procedure as described, above, for DP178, may be used in conjunction with the DP107/DP178 analog of interest.

5.6.1 Screening Assays

As demonstrated in the Example presented in Section 8, below DP107 and DP178 portions of the TM protein gp41, i.e., the HR1 and HR2 portions of gp41, respectively, form non-covalent protein—protein interactions. As is also demonstrated, the maintenance of such interactions is necessary for normal viral infectivity. Thus, compounds which bind DP107, bind DP178, and/or act to disrupt normal DP107/DP178 protein—protein interactions may act as antifusogenic, antiviral or cellular modulatory agents. Described below are assays for the identification of such compounds. Note that, while, for ease and clarity of discussion, DP107 and DP178 peptides will be used as components of the assays described, but it is to be understood that any of the DP107 analog or DP178 analog peptides described, above, in Sections 5.1 through 5.3 may also be utilized as part of these screens for compounds.

For example, in certain embodiments the assays of the invention may be use DP107 and/or DP178 analogs that contain one or more amino acid residue truncations, deletions, insertions and substitutions. In particular, in one preferred embodiment, the DP107, DP178, DP107-like and DP178-like peptides can comprise amino and/or carboxy-terminal insertions corresponding to about two to about fifty amino acids amino-to or carboxy-to the endogenous sequence from which the DP107, DP178, DP107-like or DP178-like peptide is derived. In another particular embodiment, the peptides used in the assays described herein further comprise additional, heterologous sequence useful for detecting, immobilizing and/or purifying the particular peptide. Such heterologous sequences include, but are not limited to maltose binding fusion proteins containing a DP178, DP107, DP178-like or DP107-like sequence such as the M41Δ178 and MF5.1 maltose binding fusion proteins described in Sections 8 and 30, below.

In certain embodiments, such analogs will have reduced binding affinities and are therefore useful, e.g., to screen for compounds which inhibit the formation of or, alternatively, disrupt complexes between DP107/DP178 complexes. Among such reduced binding analogs are peptides exhibiting one or more alanine insertion or substitutions, including, e.g., the peptides described in the examples presented in Sections 30 and 31, below. It is understood that such analogs which have reduced binding affinities, including the analogs described in Sections 30 and 31 below, are also part of the present invention.

Compounds which may be tested for an ability to bind DP107, DP178, and/or disrupt DP107/DP178 interactions, and which therefore, potentially represent antifusogenic, antiviral or intracellular modulatory compounds, include, but are not limited to, peptides made of D- and/or L-configuration amino acids (in, for example, the form of random peptide libraries; see Lam, K. S. et al., 1991, Nature 354:82–84), phosphopeptides (in, for example, the form of randon or partially degenerate, directed phosphopeptide libraries; see, for example, Songyang, Z. et al., 1993, Cell 72:767–778), antibodies, and small organic or inorganic molecules. Synthetic compounds, natural products, and other sources of potentially effective materials may be screened in a variety of ways, as described in this Section.

Compounds that can be screened, tested and identified as modulating HR1/HR2 DP178/DP107 and/or DP178-like/DP107-like interactions utilizing the methods described herein can, in general, include, e.g., small molecules that are of a molecular weight up to about 1500 daltons. Test compounds, including small molecules, can include, but are not limited to, compounds obtained from any commercial source, including Aldrich (1001 West St. Paul Ave., Milwaukee, Wis. 53233), Sigma Chemical (P.O. Box 14508, St. Louis, Mo. 63178), Fluka Chemie Ag (Industriestrasse 25, CH-9471 Buchs, Switzerland (Fluka Chemical Corp. 980 South 2nd Street, Ronkonkoma, N.Y. 11779)), Eastman Chemical Company, Fine Chemicals (P.O. Box 431, Kingsport, Tenn. 37662), Boehringer Mannheim GmbH (Sandhofer Strasse 116, D-68298 Mannheim, Takasago (4 Volvo Drive, Rockleigh, N.J. 07647), SST Corporation (635 Brighton Road, Clifton, N.J. 07012), Ferro (111 West Irene Road, Zachary, La. 70791), Riedel-deHaen Aktiengesellschaft (P.O. Box D-30918, Seelze, Germany), PPG Industries Inc., Fine Chemicals (One PPG Place, 34th Floor, Pittsburgh, Pa. 15272). Further any kind of natural products may be screened using the methods of the invention, including microbial, fungal or plant extracts.

Furthermore, diversity libraries of test compounds, including small molecule test compounds, may be commercially obtained from Specs and BioSpecs B. V. (Rijswijk, The Netherlands), Chembridge Corporation (San Diego, Calif.), Contract Service Company (Dolgoprudny, Moscow Region, Russia), Comgenex USA Inc. (Princeton, N.J.), Maybridge Chemical Ltd. (Cornwall PL34 OHW, United Kingdom), and Asinex (Moscow, Russia). Combinatorial libraries of test compounds, including small molecule tested compounds, can be may be generated as disclosed in Eichler & Houghten, 1995, Mol. Med. Today 1:174–180; Dolle, 1997, Mol. Divers. 2:223–236; Lam, 1997, Anticancer Drug Des. 12:145–167. These references are incorporated hereby by reference in their entirety. It is to be noted that such references also teach additional screening methods which may be employed for the further testing of compounds identified via the methods of the invention and which can aid in identifying and isolating compounds which can represent leads and therapeutic compounds.

The compounds, antibodies, or other molecules identified may be tested, for example, for an ability to inhibit cell fusion or viral activity, utilizing, for example, assays such as those described, above, in Section 5.5.

Among the peptides which may be tested are soluble peptides comprising DP107 and/or DP178 domains, and peptides comprising DP107 and/or DP178 domains having one or more mutations within one or both of the domains, such as the M41-P peptide described below, in the Example presented in Section 8, which contains a isoleucine to proline mutation within the DP178 sequence.

In one embodiment of such screening methods is a method for identifying a compound to be tested for antiviral ability comprising:

1. exposing at least one compound to a peptide comprising a DP107 peptide for a time sufficient to allow binding of the compound to the DP107 peptide;
2. removing non-bound compounds; and
3. determining the presence of the compound bound to the DP107 peptide, thereby identifying an agent to be tested for antiviral ability.

In a second embodiment of such screening methods is a method for identifying a compound to be tested for antiviral ability comprising:

(a) exposing at least one compound to a peptide comprising a DP178 for at time sufficient to allow binding of the compound to the DP178 peptide;
(b) removing non-bound compounds; and
(c) determining the presence of the compound bound to the DP178 peptide, thereby identifying the agent to be tested for antiviral ability.

One method utilizing these types of approaches that may be pursued in the isolation of such DP107-binding or DP178-binding compounds is an assay which would include the attachment of either the DP107 or the DP178 peptide to a solid matrix, such as, for example, agarose or plastic beads, microtiter plate wells, petri dishes, or membranes composed of, for example, nylon or nitrocellulose. In such an assay system, either the DP107 or DP178 protein may be anchored onto a solid surface, and the compound, or test substrate, which is not anchored, is labeled, either directly or indirectly (e.g., with a radioactive label such as $^{125}I$, an absorption label such as biotin, or a fluorescent label such as fluorescein or rhodamine). In practice, microtiter plates are conveniently utilized. The anchored component may be immobilized by non-covalent or covalent attachments. Non-covalent attachment may be accomplished simply by coating the solid surface with a solution of the protein and drying. Alternatively, an immobilized antibody, preferably a monoclonal antibody, specific for the protein may be used to anchor the protein to the solid surface. The surfaces may be prepared in advance and stored.

In order to conduct the assay, the labeled compound is added to the coated surface containing the anchored DP107 or DP178 peptide. After the reaction is complete, unreacted components are removed (e.g., by washing) under conditions such that any complexes formed will remain immobilized on the solid surface. The detection of complexes anchored on the solid surface can be accomplished in a number of ways. Where the compound is pre-labeled, the detection of label immobilized on the surface indicates that complexes were formed. Where the labeled component is not pre-labeled, an indirect label can be used to detect complexes anchored on the surfaces; e.g., using a labeled antibody specific for the compound (the antibody, in turn, may be directly labeled or indirectly labeled with a labeled anti-Ig antibody).

Alternatively, such an assay can be conducted in a liquid phase, the reaction products separated from unreacted components, and complexes detected; e.g., using an immobilized antibody specific for DP107 or DP178, whichever is appropriate for the given assay, or ab antibody specific for the compound, i.e., the test substance, in order to anchor any complexes formed in solution, and a labeled antibody specific for the other member of the complex to detect anchored complexes.

By utilizing procedures such as this, large numbers of types of molecules may be simultaneously screened for DP107 or DP178-binding capability, and thus potential antiviral activity.

Further, compounds may be screened for an ability to inhibit the formation of or, alternatively, disrupt DP107/DP178 complexes. Such compounds may then be tested for antifusogenic, antiviral or intercellular modulatory capability. For ease of description, DP107 and DP178 will be referred to as "binding partners." Compounds that disrupt such interactions may exhibit antiviral activity. Such compounds may include, but are not limited to molecules such as antibodies, peptides, and the like described above.

The basic principle of the assay systems used to identify compounds that interfere with the interaction between the DP107 and DP178 peptide involves preparing a reaction mixture containing peptides under conditions and for a time sufficient to allow the two peptides to interact and bind, thus forming a complex. In order to test a compound for disruptive activity, the reaction is conducted in the presence and absence of the test compound, i.e., the test compound may be initially included in the reaction mixture, or added at a time subsequent to the addition of one of the binding partners; controls are incubated without the test compound or with a placebo. The formation of any complexes between the binding partners is then detected. The formation of a complex in the control reaction, but not in the reaction mixture containing the test compound indicates that the compound interferes with the interaction of the DP107 and DP178 peptides.

The assay for compounds that interfere with the interaction of the binding partners can be conducted in a heterogeneous or homogeneous format. Heterogeneous assays involve anchoring one of the binding partners onto a solid phase and detecting complexes anchored on the solid phase at the end of the reaction. In homogeneous assays, the entire reaction is carried out in a ligand phase. In either approach, the order of addition of reactants can be varied to obtain different information about the compounds being tested. For example, test compounds that interfere with the interaction between the binding partners, e.g., by competition, can be identified by conducting the reaction in the presence of the test substance; i.e., by adding the test substance to the reaction mixture prior to or simultaneously with the binding partners. On the other hand, test compounds that disrupt preformed complexes, e.g. compounds with higher binding constants that displace one of the binding partners from the complex, can be tested by adding the test compound to the reaction mixture after complexes have been formed. The various formats are described briefly below.

In a heterogeneous assay system, one binding partner, e.g., either the DP107 or DP178 peptide, is anchored onto a solid surface, and its binding partner, which is not anchored, is labeled, either directly or indirectly (e.g., with a radioactive label such as $^{125}$I, an absorption label such as biotin, or a fluorescent label such as fluorescein or rhodamiine). In practice, microtiter plates are conveniently utilized. The anchored species may be immobilized by non-covalent or covalent attachments. Non-covalent attachment may be accomplished simply by coating the solid surface with a solution of the protein and drying. Alternatively, an immobilized antibody specific for the protein may be used to anchor the protein to the solid surface. The surfaces may be prepared in advance and stored.

In order to conduct the assay, the binding partner of the immobilized species is added to the coated surface with or without the test compound. After the reaction is complete, unreacted components are removed (e.g., by washing) and any complexes formed will remain immobilized on the solid surface. The detection of complexes anchored on the solid surface can be accomplished in a number of ways. Where the binding partner was pre-labeled, the detection of label immobilized on the surface indicates that complexes were formed. Where the binding partner is not pre-labeled, and indirect label can be used to detect complexes anchored on the surface; e.g., using a labeled antibody specific for the binding partner (the antibody, in turn, may be directly labeled or indirectly labeled with a labeled anti-Ig antibody). Depending upon the order of addition of reaction components, test compounds which inhibit complex formation or which disrupt preformed complexes can be detected.

Alternatively, the reaction can be conducted in a liquid phase in the presence or absence of the test compound, the reaction products separated from unreacted components, and complexes detected; e.g., using an immobilized antibody specific for one binding partner to anchor any complexes formed in solution, and a labeled antibody specific for the other binding partner to detect anchored complexes. Again, depending upon the order of addition of reactants to the liquid phase, test compounds which inhibit complex or which disrupt preformed complexes can be identified.

In an alternate embodiment of the invention, a homogeneous assay can be used. In this approach, a preformed complex of the DP107 and DP178 peptides is prepared in which one of the binding partners is labeled, but the signal generated by the label is quenched due to the complex formation (see, e.g., U.S. Pat. No. 4,109,496 by Rubenstein which utilizes this approach for immunoassays). The addition of a test substance that competes with and displaces one of the binding partners from the preformed complex will result in the generation of a signal above background. In this way, test substances which disrupt DP-107/DP-178 protein—protein interaction can be identified.

In still another embodiment of the invention, fluorescence polarization may be used in a homogeneous assay. In this approach, complex formation is detected by measuring the polarization of a fluorescently labeled peptide (e.g., with fluorescein or rhodamine) in a sample. Binding of the peptide to its complementary HR1 or HR2 binding domain in a larger molecular weight peptide or protein, such as in a maltose binding fusion protein described herein, alters the correlation time of the fluorescent moiety and thereby decreases the fluoescence polarization of the labeled peptide.

In an alternative screening assay, test compounds may be assayed for the their ability to disrupt a DP178/DP107 interaction, as measured immunometrically using an antibody specifically reactive to a DP107/DP178 complex (i.e., an antibody that recognizes neither DP107 nor DP178 individually). Such an assay acts as a competition assay, and is based on techniques well known to those of skill in the art.

The above competition assay may be described, by way of example, and not by way of limitation, by using the DP178 and M41Δ178 peptides and by assaying test compounds for the disruption of the complexes formed by these two peptides by immunometrically visualizing DP178/M41Δ178 complexes via the human recombinant Fab, Fab-d, as described, below, in the Example presented in Section 8. M41Δ178 is a maltose binding fusion protein containing a gp41 region having its DP178 domain deleted, and is described, below, in the Example presented in Section 8.

Utilizing such an assay, M41Δ178 may be immobilized onto solid supports such as microtiter wells. A series of dilutions of a test compound may then be added to each M41Δ178-containing well in the presence of a constant concentration of DP-178 peptide. After incubation, at, for example, room temperature for one hour, unbound DP-178 and test compound are removed from the wells and wells are then incubated with the DP178/M41Δ178-specific Fab-d antibody. After incubation and washing, unbound Fab-d is removed from the plates and bound Fab-d is quantitated. A no-inhibitor control should also be conducted. Test compounds showing an ability to disrupt DP178/M41Δ178 complex formation are identified by their concentration-dependent decrease in the level of Fab-d binding.

A variation of such an assay may be utilized to perform a rapid, high-throughput binding assay which is capable of directly measuring DP178 binding to M41Δ178 for the determination of binding constants of the ligand of inhibitory constants for competitors of DP178 binding.

Such an assay takes advantages of accepted radioligand and receptor binding principles. (See, for example, Yamamura, H. I. et al., 1985, "Neurotransmitter Receptor Binding", 2nd ed., Raven Press, NY.) As above, M41Δ178 is immobilized onto a solid support such as a microtiter well. DP178 binding to M41Δ178 is then quantitated by measuring the fraction of DP178 that is bound as $^{125}$I-DP178 and calculating the total amount bound using a value for specific activity (dpm/μg peptide) determined for each labeled DP178 preparation. Specific binding to M41Δ178 is defined as the difference of the binding of the labeled DP178 preparation in the microtiter wells (totals) and the binding in identical wells containing, in addition, excess unlabeled DP178 (nonspecifics).

Because the binding affinity for native DP178 and DP107 is very high (including native DP178-like and DP107-like peptides from other species; e.g., 10 nM for DP178 in HIV-1, and 2 nM for T112 in RSV), test compounds must exhibit high binding properties to interfere with or disrupt the DP178/DP107 binding interaction. Accordingly, in another non-limiting example of the above-described competitions assays, such assays can be performed using "modified" DP107 and/or DP178 peptides (e.g., DP107 and/or DP178 analogs) which have reduced binding affinities relatived to the unmodified "parent peptides". The use of such modified DP107 and DP178 peptides greatly increases the sensitivity of the competition assays of the invention by identifying more compounds with inhibitory potential. The binding affinities of compounds identified in the assays can then be optimized, e.g., using standard medicinal chemistry techniques, to generate compounds that are more powerful inhibitors of DP107/DP178 complex formation and are therefore useful, e.g., as antiviral reagents. Alternatively, compounds identified in the competition assays using DP107 and/or DP178 analogs with reduced binding affinities may, themselves, be useful, e.g., as antiviral reagents.

The term "reduced affinity," as used herein, refers to a DP107, DP178, DP107-like or DP178-like peptide that interacts with and forms a DP107/DP178 peptide pair, a HR1/DP178 pair or an HR2/DP107 pair under competition assay conditions, but interacts with its "partner" to form such a pair with a lower affinity than would a DP107 or DP178 "parent" peptide from which the reduced affinity peptide is derived.

Generally, the binding affinity of a peptide can be expressed as a $B_{50}$ value, i.e., the concentration of peptide necessary for 50% of the peptide molecules to bind to their target under a given set of conditions. Preferably, the $B_{50}$ value of a reduced affinity peptide will be at least twice, and more preferably at least five times, at least 10 times, at least 20 times, or at least 100 times the $B_{50}$ value of the unmodified peptide from which it was derived.

Modified DP107 and DP178 peptides that have reduced binding affinities may be generated according to any number of techniques that will be readily apparent to those skilled in the art. For example, in one embodiment modified DP107 and DP178 peptides with reduced binding affinities may be generated by generating truncated DP107 and DP178 peptides, respectively. Such peptides may be routinely, synthesized and tested, e.g., by the above described screening assays, to determine their binding affinities to their target. For example, as described in the example presented below in Section 30, reducing the length of the native RSV DP178-like peptide T112 from 35 to 28 amino acid residues resulted in a five fold drop in binding affinity (from 1 nM to 5 nM). Generally, such truncation can be of 1, 2, 3, 4, 5, 6, 7, 8, 9 or 10 amino acid residues.

Alternatively, modified DP107 and DP178 peptides with reduced binding affinity may be identified and generated by identifying and substituting, inserting or deleting amino acid residues. For example in one embodiment, which is also demonstrated in the example presented below in section 30, modified DP107 and/or DP178 peptides may be routinely synthesized and assayed for reduced binding affinity by systematically replacing one or more amino acid residues of the native DP107 or DP178 peptide with other amino acid residues and testing the binding affinity of the resulting peptide by techniques such as those described herein. Preferably, the substituted amino acid residues are neutral amino acid residues exhibiting relatively small side chains, such as alanine or glycine.

Such substitutions can identify "key" amino acid residues and can be used in the competition assays of the invention. Alternatively, upon identification of key residues by such systematic substitutions, the key residues can be changed to other residues and the resulting, modified peptides can be tested for binding affinity.

Modified DP107 and/or DP178 peptides that have reduced binding affinities may still further be identified using principles of protein chemistry and design that are well known to those of skill in the art. Specifically, such principles may be used to identify those amino acid residues of a native DP107 or DP178 sequence that effect, e.g., solubility, binding affinity, or stability of the peptide. Thus, for example, using known principles of amino acid chemistry and protein design one skilled in the art could identify amino acid residues in a native DP107 or DP178 peptide that affect the structure of the peptide.

5.7 Pharmaceutical Formulations, Dosages and Modes of Administration

The peptides of the invention may be administered using techniques well known to those in the art. Preferably, agents are formulated and administered systemically. Techniques for formulation and administration may be found in "Remington's Pharmaceutical Sciences", 18th ed., 1990, Mack Publishing Co., Easton, Pa. Suitable routes may include oral, rectal, transmucosal, or intestinal administration; parenteral delivery, including intramuscular, subcutaneous, intramedullary injections, as well as, intrathecal, direct intraventricular, intravenous, intraperitoneal, intranasal, or intraocular injections, just to name a few. For injection, the agents of the invention may be formulated in aqueous solutions, preferably in physiologically compatible buffers such as Hanks' solution, Ringer's solution, or physiological saline buffer. For such transmucosal administration, penetrants appropriate to the barrier to be permeated are used in the formulation. Such penetrants are generally known in the art.

In instances wherein intracellular administration of the peptides of the invention or other inhibitory agents is preferred, techniques well known to those of ordinary skill in the art may be utilized. For example, such agents may be encapsulated into liposomes, then administered as described above. Liposomes are spherical lipid bilayers with aqueous interiors. All molecules present in an aqueous solution at the time of liposome formation are incorporated into the aqueous interior. The liposomal contents are both protected from the external microenvironment and, because liposomes fuse with cell membranes, are effectively delivered into the cell cytoplasm. Additionally, due to their hydrophobicity, when small molecules are to be administered, direct intracellular administration may be achieved.

Nucelotide sequences encoding the peptides of the invention which are to be intracellularly administered may be expressed in cells of interest, using techniques well known to those of skill in the art. For example, expression vectors derived from viruses such as retroviruses, vaccinia viruses, adeno-associated viruses, herpes viruses, or bovine papilloma viruses, may be used for delivery and expression of such nucleotide sequences into the targeted cell population. Methods for the construction of such vectors and expression constructs are well known. See, for example, Sambrook et al., 1989, Molecular Cloning, A Laboratory Manual, Cold Spring Harbor Press, Cold Spring Harbor N.Y., and Ausubel et al., 1989, Current Protocols in Molecular Biology, Greene Publishing Associates and Wiley Interscience, NY.

With respect to HIV, peptides of the invention, particularly DP107 and DP178, may be used as therapeutics in the treatment of AIDS. In addition, the peptides may be used as prophylactic measures in previously uninfected individuals after acute exposure to an HIV virus. Examples of such prophylactic use of the peptides may include, but are not limited to, prevention of virus transmission from mother to infant and other settings where the likelihood of HIV transmission exists, such as, for example, accidents in health care settings wherein workers are exposed to HIV-containing blood products. The successful use of such treatments do not rely upon the generation of a host immune response directed against such peptides.

Effective dosages of the peptides of the invention to be administered may be determined through procedures well known to those in the art which address such parameters as biological half-life, bioavailability, and toxicity. Given the data presented below in Section 6, DP178, for example, may prove efficacious in vivo at doses required to achieve circulating levels of about 1 to about 10 ng per ml of peptide.

A therapeutically effective dose refers to that amount of the compound sufficient to result in amelioration of symptoms or a prolongation of survival in a patient. Toxicity and therapeutic efficacy of such compounds can be determined by standard pharmaceutical procedures in cell cultures or experimental animals, e.g., for determining the $LD_{50}$ (the dose lethal to 50% of the population) and the ED50 (the dose therapeutically effective in 50% of the population). The dose ratio between toxic and therapeutic effects is the therapeutic index and it can be expressed as the ratio $LD_{50}/ED_{50}$. Compounds which exhibit large therapeutic indices are preferred. The data obtained from these cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the $IC_{50}$ (e.g., the concentration of the test compound which achieves a half-maximal inhibition of the fusogenic event, such as a half-maximal inhibition of viral infection relative to the amount of the event in the absence of the test compound) as determined in cell culture. Such information can be used to more accurately determine useful doses in humans. Levels in plasma may be measured, for example, by high performance liquid chromatography (HPLC).

The peptides of the invention may, further, serve the role of a prophylactic vaccine, wherein the host raises antibodies against the peptides of the invention, which then serve to neutralize HIV viruses by, for example, inhibiting further HIV infection.

Administration of the peptides of the invention as a prophylactic vaccine, therefore, would comprise administering to a host a concentration of peptides effective in raising an immune response which is sufficient to neutralize HIV, by, for example, inhibiting HIV ability to infect cells. The exact concentration will depend upon the specific peptide to be administered, but may be determined by using standard techniques for assaying the development of an immune response which are well known to those of ordinary skill in the art. The peptides to be used as vaccines are usually administered intramuscularly.

The peptides may be formulated with a suitable adjuvant in order to enhance the immunological response. Such adjuvants may include, but are not limited to mineral gels such as aluminum hydroxide; surface active substances such as lysolecithin, pluronic polyols, polyanions; other peptides; oil emulsions; and potentially useful human adjuvants such as BCG and Corynebacterium parvum. Many methods may be used to introduce the vaccine formulations described here. These methods include but are not limited to oral, intradermal, intramuscular, intraperitoneal, intravenous, subcutaneous, and intranasal routes.

Alternatively, an effective concentration of polyclonal or monoclonal antibodies raised against the peptides of the invention may be administered to a host so that no uninfected cells become infected by HIV. The exact concentration of such antibodies will vary according to each specific antibody preparation, but may be determined using standard techniques well known to those of ordinary skill in the art. Administration of the antibodies may be accomplished using a variety of techniques, including, but not limited to those described in this section.

For all such treatments described above, the exact formulation, route of administration and dosage can be chosen by the individual physician in view of the patient's condition. (See e.g. Fingl et al., 1975, in "The Pharmacological Basis of Therapeutics", Ch. 1 p1).

It should be noted that the attending physician would know how to and when to terminate, interrupt, or adjust administration due to toxicity, or to organ dysfunctions. Conversely, the attending physician would also know to adjust treatment to higher levels if the clinical response were not adequate (precluding toxicity). The magnitude of an administrated dose in the management of the oncogenic disorder of interest will vary with the severity of the condition to be treated and the route of administration. The dose and perhaps dose frequency, will also vary according to the age, body weight, and response of the individual patient. A program comparable to that discussed above may be used in veterinary medicine.

Use of pharmaceutically acceptable carriers to formulate the compounds herein disclosed for the practice of the invention into dosages suitable for systemic administration is within the scope of the invention. With proper choice of carrier and suitable manufacturing practice, the compositions of the present invention, in particular, those formulated as solutions, may be administered parenterally, such as by intravenous injection. The compounds can be formulated readily using pharmaceutically acceptable carriers well known in the art into dosages suitable for oral administration. Such carriers enable the compounds of the invention to be formulated as tablets, pills, capsules, liquids, gels, syrups, slurries, suspensions and the like, for oral ingestion by a patient to be treated.

Pharmaceutical compositions suitable for use in the present invention include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of the active compounds into preparations which can be used pharmaceutically. The preparations formulated for oral administration may be in the form of tablets, dragees, capsules, or solutions.

The pharmaceutical compositions of the present invention may be manufactured in a manner that is itself known, e.g., by means of conventional mixing, dissolving, granulating, dragee-making, levigating, emulsifying, encapsulating, entrapping or lyophilizing processes.

Pharmaceutical formulations for parenteral administration include aqueous solutions of the active compounds in water-soluble form. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Aqueous injection suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Pharmaceutical preparations for oral use can be obtained by combining the active compounds with solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, desintegrating agents may be added, such as the cross-linked polyvinyl pyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to the tablets or dragee coatings for identification or to characterize different combinations of active compound doses.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added.

6. EXAMPLE: DP178 (SEQ ID:1) IS A POTENT INHIBITOR OF HIV-1 INFECTION

In this example, DP178 (SEQ ID:1) is shown to be a potent inhibitor of HIV-1 mediated CD-4$^+$ cell-cell fusion and infection by cell free virus. In the fusion assay, this peptide completely blocks virus induced syncytia formation at concentrations of from 1–10 ng/ml. In the infectivity assay the inhibitory concentration is somewhat higher, blocking infection at 90 ng/ml. It is further shown that DP178 (SEQ ID:1) shows that the antiviral activity of DP178 (SEQ ID:1) is highly specific for HIV-1. Additionally, a synthetic peptide, DP-185 (SEQ ID:3), representing a HIV-1-derived DP178 homolog is also found to block HIV-1-mediated syncytia formation.

6.1. Materials and Methods

6.1.1. Peptide Synthesis

Peptides were synthesized using Fast Moc chemistry on an Applied Biosystems Model 431A peptide synthesizer.

Generally, unless otherwise noted, the peptides contained amidated carboxy termini and acetylated amino termini. Amidated peptides were prepared using Rink resin (Advanced Chemtech) while peptides containing free carboxy termini were synthesized on Wang (p-alkoxy-benzyl-alcohol) resin (Bachem). First residues were double coupled to the appropriate resin and subsequent residues were single coupled. Each coupling step was followed by acetic anhydride capping. Peptides were cleaved from the resin by treatment with trifluoracetic acid (TFA) (10 ml), $H_2O$ (0.5 ml), thioanisole (0.5 ml), ethanedithiol (0.25 ml), and crystalline phenol (0.75 g). Purification was carried out by reverse phase HPLC. Approximately 50 mg samples of crude peptide were chromatographed on a Waters Delta Pak C18 column (19 mm×30 cm, 15μ spherical) with a linear gradient; $H_2O$/acetonitrile 0.1% TFA. Lyophilized peptides were stored desiccated and peptide solutions were made in water at about 1 mg/ml. Electrospray mass spectrometry yielded the following results: DP178 (SEQ ID:1):4491.87 (calculated 4491.94); DP-180 (SEQ ID:2):4491.45 (calculated 4491.94); DP-185 (SEQ ID:3):not done (calculated 4546.97).

6.1.2. Virus

The HIV-1$_{LAI}$ virus was obtained from R. Gallo (Popovic, M. et al., 1984, Science 224:497–508) and propagated in CEM cells cultured in RPMI 1640 containing 10% fetal calf serum. Supernatant from the infected CEM cells was passed through a 0.2 μm filter and the infectious titer estimated in a microinfectivity assay using the AA5 cell line to support virus replication. For this purpose, 25 μl of serial diluted virus was added to 75 μl AA5 cells at a concentration of 2×10$^5$/ml in a 96-well microtitre plate. Each virus dilution was tested in triplicate. Cells were cultured for eight days by addition of fresh medium every other day. On day 8 post infection, supernatant samples were tested for virus replication as evidenced by reverse transcriptase activity released to the supernatant. The TCID$_{50}$ was calculated according to the Reed and Muench formula (Reed, L. J. et al., 1938, Am. J. Hyg. 27:493–497). The titer of the HIV-1$_{LAI}$ and HIV-1$_{MN}$ stocks used for these studies, as measured on the AA5 cell line, was approximately 1.4×10$^6$ and 3.8×10$^4$ TCD$_{50}$/ml, respectively.

6.1.3. Cell Fusion Assay

Approximately 7×10$^4$ Molt cells were incubated with 1×10$^4$ CEM cells chronically infected with the HIV-1$_{LAI}$ virus in 96-well plates (one-half area cluster plates; Costar, Cambridge, Mass.) in a final volume of 100 μl culture medium as previously described (Matthews, T. J. et al., 1987, Proc. Natl. Acad. Sci. USA 84: 5424–5428). Peptide inhibitors were added in a volume of 10 μl and the cell mixtures were incubated for 24 hr. at 37° C. At that time, multinucleated giant cells were estimated by microscopic examination at a 40× magnification which allowed visualization of the entire well in a single field.

6.1.4. Cell Free Virus Infection Assay

Synthetic peptides were incubated at 37° C. with either 247 TCID$_{50}$ (for experiment depicted in FIG. 2), or 62 TCID$_{50}$ (for experiment depicted in FIG. 3) units of HIV-1$_{LAI}$ virus or 25 TCID$_{50}$ units of HIV-2$_{NIHZ}$ and CEM CD4$^+$ cells at peptide concentrations of 0, 0.04, 0.4, 4.0, and 40 μg/ml for 7 days. The resulting reverse transcriptase (RT) activity in counts per minute was determined using the assay described, below, in Section 6.1.5. See Reed, L. J. et al., 1938, Am. J. Hyg. 27: 493–497 for an explanation of TCID$_{50}$ calculations.

6.1.5. Reverse Transcriptase Assay

The micro-reverse transcriptase (RT) assay was adapted from Goff et al. (Goff, S. et al., 1981, J. Virol. 38:239–248) and Willey et al. (Willey, R. et al., 1988, J. Virol. 62:139–147). Supernatants from virus/cell cultures are adjusted to 1% Triton-X100. A 10 μl sample of supernatant was added to 50 μl of RT cocktail in a 96-well U-bottom microtitre plate and the samples incubated at 37° C. for 90 min. The RT cocktail contained 75 mM KCl, 2 mM dithiothreitol, 5 mM MgCl$_2$, 5 μg/ml poly A (Pharmacia, cat. No. 27-4110-01), 0.25 units/ml oligo dT (Pharmacia, cat. No. 27-7858-01), 0.05% NP40, 50 mM Tris-HCl, pH 7.8, 0.5 μM non-radioactive dTTP, and 10 μCi/ml $^{32}$P-dTTP (Amersham, cat. No. PB.10167).

After the incubation period, 40 μl of reaction mixture was applied to a Schleicher and Schuell (S+S) NA45 membrane (or DE81 paper) saturated in 2×SSC buffer (0.3M NaCl and 0.003M sodium citrate) held in a S+S Minifold over one sheet of GB003 (S+S) filter paper, with partial vacuum applied. Each well of the minifold was washed four times with 200 μl 2×SSC, under full vacuum. The membrane was removed from the minifold and washed 2 more times in a pyrex dish with an excess of 2×SSC. Finally, the membrane was drained on absorbent paper, placed on Whatman #3 paper, covered with Saran wrap, and exposed to film overnight at −70° C.

6.2. Results

6.2.1. Peptide Inhibition of Infected Cell-Induced Syncytia Formation

The initial screen for antiviral activity assayed peptides' ability to block syncytium formation induced by overnight co-cultivation of uninfected Molt4 cells with chronically HIV-1 infected CEM cells. The results of several such experiments are presented herein. In the first of these experiments, serial DP178 (SEQ ID:1) peptide concentrations between 10 μg/ml and 12.5 ng/ml were tested for blockade of the cell fusion process. For these experiments, CEM cells chronically infected with either HIV-1$_{LAI}$, HIV-1$_{MN}$, HIV-1$_{RF}$, or HIV-1$_{SF2}$ virus were cocultivated overnight with uninfected Molt 4 cells. The results (FIG. 4) show that DP178 (SEQ ID:1) afforded complete protection against each of the HIV-1 isolates down to the lowest concentration of DP178 (SEQ ID:1) used. For HIV$_{LAI}$ inhibition, the lowest concentration tested was 12.5 ng/ml; for all other HIV-1 viruses, the lowest concentration of DP178 (SEQ ID:1) used in this study was 100 ng/ml. A second peptide, DP-180 (SEQ ID:2), containing the same amino acid residues as DP178 (SEQ ID:1) but arranged in a random order exhibited no evidence of anti-fusogenic activity even at the high concentration of 40 μg/ml (FIG. 4). These observations indicate that the inhibitory effect of DP178 (SEQ ID:1) is primary sequence-specific and not related to non-specific peptide/protein interactions. The actual endpoint (i.e., the lowest effective inhibitory concentration) of DP178 inhibitory action is within the range of 1–10 ng/ml.

The next series of experiments involved the preparation and testing of a DP178 (SEQ ID:1) homolog for its stability to inhibit HIV-1-induced syncytia formation. As shown in FIG. 1, the sequence of DP-185 (SEQ ID:3) is slightly different from DP178 (SEQ ID:1) in that its primary sequence is taken from the HIV-1$_{SF2}$ isolate and contains several amino acid differences relative to DP178 (SEQ ID:1) near the N terminus. As shown in FIG. 4, DP-185 (SEQ ID:3), exhibits inhibitory activity even at 312.5 ng/ml, the lowest concentration tested.

The next series of experiments involved a comparison of DP178 (SEQ ID:1) HIV-1 and HIV-2 inhibitory activity. As shown in FIG. 5, DP178 (SEQ ID:1) blocked HIV-1-mediated syncytia formation at peptide concentrations below 1 ng/ml. DP178 (SEQ ID:1) failed, however, to block HIV-2 mediated syncytia formation at concentrations as high as 10 µg/ml. This striking 4 log selectivity of DP178 (SEQ ID:1) as an inhibitor of HIV-1-mediated cell fusion demonstrates an unexpected HIV-1 specificity in the action of DP178 (SEQ ID:1). DP178 (SEQ ID:1) inhibition of HIV-1-mediated cell fusion, but the peptide's inability to inhibit HIV-2 medicated cell fusion in the same cell type at the concentrations tested provides further evidence for the high degree of selectively associated with the antiviral action of DP178 (SEQ ID:1).

6.2.2. Peptide Inhibition of Infection by Cell-Free Virus

DP178 (SEQ ID:1) was next tested for its ability to block CD-4+ CEM cell infection by cell free HIV-1 virus. The results, shown in FIG. 2, are from an experiment in which DP178 (SEQ ID:1) was assayed for its ability to block infection of CEM cells by an HIV-1$_{LAI}$ isolate. Included in the experiment were three control peptides, DP-116 (SEQ ID:9), DP-125 (SEQ ID:8), and DP-118 (SEQ ID:10). DP-116 (SEQ ID:9) represents a peptide previously shown to be inactive using this assay, and DP-125 (SEQ ID:8; Wild, C. et al., 1992, Proc. Natl. Acad. Sci. USA 89:10,537) and DP-118 (SEQ ID:10) are peptides which have previously been shown to be active in this assay. Each concentration (0, 0.04, 0.4, 4, and 40 µg/ml) of peptide was incubated with 247 TCID$_{50}$ units of HIV-1$_{LAI}$ virus and CEM cells. After 7 days of culture, cell-free supernatant was tested for the presence of RT activity as a measure of successful infection. The results, shown in FIG. 2, demonstrate that DP178 (SEQ ID:1) inhibited the de novo infection process mediated by the HIV-1 viral isolate at concentrations as low as 90 ng/ml (IC50=90 ng/ml). In contrast, the two positive control peptides, DP-125 (SEQ ID:8) and DP-118 (SEQ ID:10), had over 60-fold higher IC50 concentrations of approximately 5 µg/ml.

In a separate experiment, the HIV-1 and HIV-2 inhibitory action of DP178 (SEQ ID:1) was tested with CEM cells and either HIV-1$_{LAI}$ or HIV-2$_{NIHZ}$. 62 TCID$_{50}$ HIV-1$_{LAI}$ or 25 GCID$_{50}$ HIV-2$_{NIHZ}$ were used in these experiments, and were incubated for 7 days. As may be seen in FIG. 3, DP178 (SEQ ID:1) inhibited HIV-1 infection with an IC50 of about 31 ng/ml. In contrast, DP178 (SEQ ID:1) exhibited a much higher IC50 for HIV-2$_{NIHZ}$, thus making DP178 (SEQ ID:1) two logs more potent as a HIV-1 inhibitor than a HIV-2 inhibitor. This finding is consistent with the results of the fusion inhibition assays described, above, in Section 6.2.1, and further supports a significant level of selectivity (i.e., for HIV-1 over HIV-2).

7. EXAMPLE: THE HIV-1 INHIBITOR, DP178 (SEQ ID:1) IS NON-CYTOTOXIC

In this Example, the 36 amino acid synthetic peptide inhibitor DP178 (SEQ ID:1) is shown to be non-cytotoxic to cells in culture, even at the highest peptide concentrations (40 µg/ml) tested.

7.1. Materials and Methods

Cell proliferation and toxicity assay: Approximately 3.8× 10$^5$ CEM cells for each peptide concentration were incubated for 3 days at 37° C. in T25 flasks. Peptides tested were DP178 (SEQ ID:1) and DP-116 (SEQ ID:9), as described in FIG. 1. Peptides were synthesized as described, above, in Section 6.1. The concentrations of each peptide used were 0, 2.5, 10, and 40 µg/ml. Cell counts were taken at incubation times of 0, 24, 48, and 72 hours.

7.2. Results

Whether the potent HIV-1 inhibitor DP178 (SEQ ID:1) exhibited any cytotoxic effects was assessed by assaying the peptide's effects on the proliferation and viability of cells in culture. CEM cells were incubated in the presence of varying concentrations of DP178 (SEQ ID:1), and DP-116 (SEQ ID:9), a peptide previously shown to be ineffective as a HIV inhibitor (Wild, C. et al., 1992, Proc. Natl. Acad. Sci. USA 89:10,537–10, 541). Additionally, cells were incubated in the absence of either peptide.

The results of the cytotoxicity study demonstrate that DP178 (SEQ ID:1) exhibits no cytotoxic effects on cells in culture. As can be seen, below, in Table VI, even the proliferation and viability characteristics of cells cultured for 3 days in the presence of the highest concentration of DP178 (SEQ ID:1) tested (40 µg/ml) do not significantly differ from the DP-116 (SEQ ID:9) or the no-peptide controls. The cell proliferation data is also represented in graphic form in FIG. 6. As was demonstrated in the Working Example presented above in Section 6, DP178 (SEQ ID:1) completely inhibits HIV-1 mediated syncytia formation at peptide concentrations between 1 and 10 ng/ml, and completely inhibits cell-free viral infection at concentrations of at least 90 ng/ml. Thus, this study demonstrates that even at peptide concentrations greater than 3 log higher than the HIV inhibitory dose, DP178 (SEQ ID:1) exhibits no cytotoxic effects.

TABLE VI

| Peptide | Peptide Concentration µg/ml | % Viability at time (hours) | | | |
|---|---|---|---|---|---|
| | | 0 | 24 | 48 | 72 |
| DP178 (SEQ ID:1) | 40 | 98 | 97 | 95 | 97 |
| | 10 | 98 | 97 | 98 | 98 |
| | 2.5 | 98 | 93 | 96 | 96 |
| DP116 (SEQ ID:9) | 40 | 98 | 95 | 98 | 97 |
| | 10 | 98 | 95 | 93 | 98 |
| | 2.5 | 98 | 96 | 98 | 99 |
| No Peptide | 0 | 98 | 97 | 99 | 98 |

8. EXAMPLE: THE INTERACTION OF DP178 AND DP107

Soluble recombinant forms of gp41 used in the example described below provide evidence that the DP178 peptide associates with a distal site on gp41 whose interactive structure is influenced by the DP107 leucine zipper motif. A single mutation disrupting the coiled-coil structure of the leucine zipper domain transformed the soluble recombinant gp41 protein from an inactive to an active inhibitor of HIV-1 fusion. This transformation may result from liberation of the potent DP178 domain from a molecular clasp with the leucine zipper, DP107, determinant. The results also indicate that the anti-HIV activity of various gp41 derivatives (peptides and recombinant proteins) may be due to their ability to form complexes with viral gp41 and interfere with its fusogenic process.

8.1. Materials and Methods

8.1.1. Construction of Fusion Proteins and gp41 Mutants

Construction of fusion proteins and mutants shown in FIG. 7 was accomplished as follows: the DNA sequence corresponding to the extracellular domain of gp41 (540–686) was cloned into the Xmn I site of the expression vector pMal-p2 (New England Biolab) to give M41. The gp41 sequence was amplified from pgtat (Malim et al., 1988, Nature 355: 181–183) by using polymerase chain reaction (PCR) with upstream primer 5'-ATGACGCTGACGGTACAGGCC-3' (primer A) and downstream primer 5'-TGACTAAGCTTAATACCACAGCCAATTTGTTAT-3' (primer B). M41-P was constructed by using the T7-Gen in vitro mutagenesis kit from United States Biochemicals (USB) following the supplier's instructions. The mutagenic primer (5'-GGAGCTGCTTGGGGCCCCAGAC-3') introduces an Ile to Pro mutation in M41 at position 578. M41Δ107, from which the DP-107 region has been deleted, was made using a deletion mutagenic primer 5'-CCAAATCCCCAGGAGCTGCTCGAGCTGCACTAT ACCAGAC-3' (primer C) following the USB T7-Gen mutagenesis protocol. M41Δ178, from which the DP-178 region has been deleted, was made by cloning the DNA fragment corresponding to gp41 amino acids 540–642 into the Xmn I site of pMal-p2. Primer A and 5'-ATAGCTTCTAGATTAATTGTTAATTTCTCTGTCCC-3' (primer D) were used in the PCR with the template pgtat to generate the inserted DNA fragments. M41-P was used as the template with primer A and D in PCR to generate M41-PΔ178. All inserted sequences and mutated residues were checked by restriction enzyme analysis and confirmed by DNA sequencing.

8.1.2. Purification and Characterization of Fusion Proteins

The fusion proteins were purified according to the protocol described in the manufacturer's brochure of protein fusion and purification systems from New England Biolabs (NEB). Fusion proteins (10 ng) were analyzed by electrophoresis on 8% SDS polyacrylamide gels. Western blotting analysis was performed as described by Sambrook et al., 1989, Molecular Cloning: A Laboratory Manual, 2d Ed, Cold Spring Harbor Laboratory Press, Cold Spring Harbor, N.Y., Ch. 18, pp. 64–75. An HIV-1 positive serum diluted 1000-fold, or a human FAb derived from repertoire cloning was used to react with the fusion proteins. The second antibody was HRP-conjugated goat antihuman Fab. An ECL Western blotting detection system (Amersham) was used to detect the bound antibody. A detailed protocol for this detection system was provided by the manufacturer. Rainbow molecular weight markers (Amersham) were used to estimate the size of fusion proteins.

8.1.3. Cell Fusion Assays for Anti-HIV Activity

Cell fusion assays were performed as previously described (Matthews et al., 1987, Proc. Natl. Acad. Sci. USA 84: 5424–5481). CEM cells ($7\times10^4$) were incubated with HIV-$1_{IIIB}$ chronically infected CEM cells ($10^4$) in 96-well flat-bottomed half-area plates (Costar) in 100 μl culture medium. Peptide and fusion proteins at various concentrations in 10 μl culture medium were incubated with the cell mixtures at 37° C. for 24 hours. Multinucleated syncytia were estimated with microscopic examination. Both M41 and M41-P did not show cytotoxicity at the concentrations tested and sown in FIG. 8.

Inhibition of HIV-1 induced cell-cell fusion activity was carried out in the presence of 10 nM DP178 and various concentrations of M41Δ178 or M41PΔ178 as indicated in FIG. 9. There was not observable syncytia in the presence of 10 nM DP178. No peptide or fusion protein was added in the control samples.

8.1.4. ELISA Analysis of DP178 Binding to the Leucine Zipper Motif by gp41

The amino acid sequence of DP178 used is: YTSLIH-SLIEESQNQQEKNEQELLELLELDKWASLWNWF. For enzyme linked immunoassay (ELISA), M41Δ178 or M41-PΔ178 (5 μg/ml) in 0.1M NaHCO$_3$, pH 8.6, were coated on 96 wells Linbro ELISA plates (Flow Lab, Inc.) overnight. Each well was washed three times with distilled water then blocked with 3% bovine serum albumin (BSA) for 2 hours. After blocking, peptides with 0.5% BSA in TBST (40 mM Tris-HCl pH7.5, 150 mM NaCl, 0.05% Tween 20) were added to the ELISA plates and incubated at room temperature for 1 hour. After washing three times with TBST, Fab-d was added at a concentration of 10 ng/ml with 0.5% BSA in TBST. The plates were washed three times with TBST after incubation at room temperature for 1 hour. Horse radish peroxidase (HRP) conjugated goat antihuman Fab antiserum at a 2000 fold dilution in TBST with 0.5% BSA was added to each well and incubated at room temperature for 45 minutes. The plates were then washed four times with TBST. The peroxidase substrate o-phenylene diamine (2.5 mg/ml) and 0.15% H$_2$O$_2$ were added to develop the color. The reaction was stopped with an equal volume of 4.5 N H$_2$SO$_4$ after incubation at room temperature for 10 minutes. The optical density of the stopped reaction mixture was measured with a micro plate reader (Molecular Design) at 490 nm. Results are shown in FIG. 10.

8.2. Results

8.2.1. The Expression and Characterization of the Ectodomain of gp41

As a step toward understanding the roles of the two helical regions in gp41 structure and function, the ectodomain of gp41 was expressed as a maltose binding fusion protein (M41) (FIG. 7). The fusogenic peptide sequence at the N-terminal of gp41 was omitted from this recombinant protein and its derivatives to improve stability. The maltose binding protein facilitated purification of the fusion proteins under relatively mild, non-denaturing conditions. Because the M41 soluble recombinant gp41 was not glycosylated, lacked several regions of the transmembrane protein (i.e., the fusion peptide, the membrane spanning, and the cytoplasmic domains), and was expressed in the absence of gp120, it was not expected to precisely reflect the structure of native gp41 on HIV-1 virions. Nevertheless, purified M41 folded in a manner that preserved certain discontinuous epitopes as evidenced by reactivity with human monoclonal antibodies, 98-6, 126-5, and 50-69, previously shown to bind conformational epitopes on native gp41 expressed in eukaryotic cells (Xu et al., 1991, J. Virol. 65: 4832–4838; Chen, 1994, J. Virol. 68:2002–2010). Thus, at least certain regions of native gp41 defined by these antibodies appear to be reproduced in the recombinant fusion protein M41. Furthermore, M41 reacted with a human recombinant Fab (Fab-d) that recognizes a conformational epitope on gp41 and binds HIV-1 virions as well as HIV-1 infected cells but not uninfected cells as analyzed by FACS. Deletion of either helix motif, i.e., DP107 or DP178, of the M41 fusion protein eliminated reactivity with Fab-d. These results indicate that both helical regions, separated by 60 amino acids in the primary sequence, are required to maintain the Fab-d epitope.

8.2.2. Anti-HIV Activity of the Recombinant Ectodomain of gp41

The wild type M41 fusion protein was tested for anti-HIV-1 activity. As explained, supra, synthetic peptides corresponding to the leucine zipper (DP107) and the C-terminal putative helix (DP178) show potent anti-HIV activity. Despite inclusion of both tissue regions, the recombinant M41 protein did not affect HIV-1 induced membrane fusion at concentrations as high as 50 µM (Table VII, below).

TABLE VII

DISRUPTION OF THE LEUCINE ZIPPER OF
GP41 FREES THE ANTI-HIV MOTIF

|  | DP107 | DP178 | M41 | M41-P | M41-PΔ178 |
|---|---|---|---|---|---|
| Cell fusion (IC$_{90}$) | 1 µM | 1 nM | >50 µM | 83 nM | >50 µM |
| Fab-D binding (k$_D$) | — | — | 3.5 × 10$^{-9}$ | 2.5 × 10$^{-8}$ | — |
| HIV infectivity (IC$_{90}$) | 1 µM | 80 nM | >16 µM | 66 nM | >8 µM |

[1]The affinity constants of Fab-d binding to the fusion proteins were determined using a protocol described by B. Friguet et al., 1985, J. Immunol. Method. 77:305–319.
— = No detectable binding of Fab-d to the fusion proteins.
Antiviral Infectivity Assays. 20 µl of serially diluted virus stock was incubated for 60 minutes at ambient temperature with 20 µl of the indicated concentration of purified recombinant fusion protein in RPMI 1640 containing 10% fetal bovine serum and antibiotics in a 96-well microtiter plate. 20 µl of CEM4 cells at 6 × 10$^5$ cells/ml were added to each well, and cultures were incubated at 37° C., in a humidified CO$_2$ incubator. Cells were cultured for 9 days by the addition of fresh medium every 2 to 3 days. On days 5, 7, and 9 postinfection, supernatant samples were assayed for reverse transcriptase (RT) activity, as described below, to monitor viral replication. The 50% tissue culture infectious dose (TCID$_{50}$) was calculated for each condition according to the formula of Reed & Muench, 1937, Am. J. Hyg. 27:493–497. RT activity was determined by a modification of the published methods of Goff et al., 1981, J. Virol. 38:239–248 and Willey et al., 1988, J. Virol. 62:139–147 as described in Chen et al., 1993, AIDS Res. Human Retroviruses 9:1079–1086.

Surprisingly, a single amino acid substitution, proline in place of isoleucine in the middle of the leucine zipper motif, yielded a fusion protein (M41-P) which did exhibit antiviral activity (Table XXV and FIG. 8). As seen in Table XXV, M41-P blocked syncytia formation by 90% at approximately 85 nM and neutralized HIV-1$_{IIIB}$ infection by 90% at approximately 70 nM concentrations. The anti-HIV-1 activity of M41-P appeared to be mediated by the C-terminal helical sequence since deletion of that region from M41-P yielded an inactive fusion protein, M41-PΔ178 (Table XXV). This interpretation was reinforced by experiments demonstrating that a truncated fusion protein lacking the DP178 sequence, M41Δ178, abrogated the potent anti-fusion activity of the DP178 peptide in a concentration-dependent manner (FIG. 9). The same truncated fusion protein containing the proline mutation disrupting the leucine zipper, M41-PΔ178, was not active in similar competition experiments (FIG. 9). The results indicate that the DP178 peptide associates with a second site on gp41 whose interactive structure is dependent on a wild type leucine zipper sequence. A similar interaction may occur within the wild type fusion protein, M41, and act to form an intramolecular clasp which sequesters the DP178 region, making it unavailable for anti-viral activity.

A specific association between these two domains is also indicated by other human monoclonal Fab-d studies. For example, Fab-d failed to bind either the DP178 peptide or the fusion protein M41Δ178, but its epitope was reconstituted by simply mixing these two reagents together (FIG. 10). Again, the proline mutation in the leucine zipper domain of the fusion protein, M41-PΔ178, failed to reconstitute the epitope in similar mixing experiments.

9. EXAMPLE: METHOD FOR COMPUTER-ASSISTED IDENTIFICATION OF DP107-LIKE AND DP178-LIKE SEQUENCES

A number of known coiled-coil sequences have been well described in the literature and contain heptad repeat positioning for each amino acid. Coiled-coil nomenclature labels each of seven amino acids of a heptad repeat A through G, with amino acids A and D tending to be hydrophobic positions. Amino acids E and G tend to be charged. These four positions (A, D, E, and G) form the amphipathic backbone structure of a monomeric alpha-helix. The backbones of two or more amphipathic helices interact with each other to form di-, tri-, tetrameric, etc., coiled-coil structures. In order to begin to design computer search motifs, a series of well characterized coiled coils were chosen including yeast transcription factor GCN4, Influenza Virus hemagglutinin loop 36, and human proto-oncogenes c-Myc, c-Fos, and c-Jun. For each peptide sequence, a strict homology for the A and D positions, and a list of the amino acids which could be excluded for the B, C, E, F, and G positions (because they are not observed in these positions) was determined. Motifs were tailored to the DP107 and DP178 sequences by deducing the most likely possibilities for heptad positioning of the amino acids of HIV-1 Bru DP-107, which is known to have coiled-coil structure, and HIV-1 Bru DP178, which is still structurally undefined. The analysis of each of the sequences is contained in FIG. 12. For example, the motif for GCN4 was designed as follows:

1. The only amino acids (using standard single letter amino acid codes) found in the A or D positions of GCN4 were [LMNV].

2. All amino acids were found at B, C, E, F, and G positions except {CFGIMPTW}.

3. The PESEARCH motif would, therefore, be written as follows:
[LMNV]-{CFGIMPTW}(2)-[LMNV]-{CFGIMPTW}(3)-
[LMNV]-{CFGIMPTW}(2)-[LMNV]-{CFGIMPTW}(3)-
[LMNV]-{CFGIMPTW}(2)-[LMNV]-{CFGIMPTW}(3)-
[LMNV]-{CFGIMPTW}(2)-[LMNV]-{CFGIMPTW}(3)

Translating or reading the motif: "at the first A position either L, M, N, or V must occur; at positions B and C (the next two positions) accept everything except C, F, G, I, M, P, T, or W; at the D position either L, M, N, or V must occur; at positions E, F, and G (the next 3 positions) accept everything except C, F, G, I, M, P, T, or W." This statement is contained four times in a 28-mer motif and five times in a 35-mer motif. The basic motif key then would be: [LMNV]-{CFGIMPTW}. The motif keys for the remaining well described coiled-coil sequences are summarized in FIG. 12.

The motif design for DP107 and DP178 was slightly different than the 28-mer model sequences described above due to the fact that heptad repeat positions are not defined and the peptides are both longer than 28 residues. FIG. 13 illustrates several possible sequence alignments for both DP107 and DP178 and also includes motif designs based on 28-mer, 35-mer, and full-length peptides. Notice that only slight differences occur in the motifs as the peptides are lengthened. Generally, lengthening the base peptide results in a less stringent motif. This is very useful in broadening the possibilities for identifying DP107-or DP-178-like primary amino acid sequences referred to in this document as "hits".

In addition to making highly specific motifs for each type peptide sequence to be searched, it is also possible to make "hybrid" motifs. These motifs are made by "crossing" two or more very stringent motifs to make a new search algorithm which will find not only both "parent" motif sequences but also any peptide sequences which have similarities to one, the other, or both "parents". For example, in FIG. 14 the "parent" sequence of GCN4 is crossed with each of the possible "parent" motifs of DP-107. Now the hybrid motif must contain all of the amino acids found in the A and D positions of both parents, and exclude all of the amino acids not found in either parent at the other positions. The resulting hybrid from crossing GCN4 or [LMNV] {CFGIMPTW} and DP107 (28-mer with the first L in the D position) or [ILQT] {CDFIMPST}, is [ILMNQTV] {CFIMPT}. Notice that now only two basic hybrid motifs exist which cover both framing possibilities, as well as all peptide lengths of the parent DP-107 molecule. FIG. 15 represents the "hybridizations" of GCN4 with DP-178. FIG. 16 represents the "hybridizations" of DP107 and DP178. It is important to keep in mind that the represented motifs, both parent and hybrid, are motif keys and not the depiction of the full-length motif needed to actually do the computer search.

Hybridizations can be performed on any combination of two or more motifs. FIG. 17 summarizes several three-motif hybridizations including GCN4, DP107 (both frames), and DP178 (also both frames). Notice that the resulting motifs are now becoming much more similar to each other. In fact, the first and third hybrid motifs are actually subsets of the second and fourth hybrid motifs respectively. This means that the first and third hybrid motifs are slightly more stringent than the second and fourth. It should also be noted that with only minor changes in these four motifs, or by hybridizing them, a single motif could be obtained which would find all of the sequences. However, it should be remembered that stringency is also reduced. Finally, the most broad-spectrum and least-stringent hybrid motif is described in FIG. 18 which summarizes the hybridization of GCN4, DP107 (both frames), DP178 (both frames), c-Fos, c-Jun, c-Myc, and Flu loop 36.

A special set of motifs was designed based on the fact that DP-178 is located only approximately ten amino acids upstream of the transmembrane spanning region of gp41 and just C-terminal to a proline which separates DP107 and DP178. It has been postulated that DP178 may be an amphipathic helix when membrane associated, and that the proline might aid in the initiation of the helix formation. The same arrangement was observed in Respiratory Syncytial Virus; however, the DP178-like region in this virus also had a leucine zipper just C-terminal to the proline. Therefore, N-terminal proline-leucine zipper motifs were designed to analyze whether any other viruses might contain this same pattern. The motifs are summarized in FIG. 19.

The PC/Gene protein database contains 5879 viral amino acid sequences (library file PVIRUSES; CD-ROM release 11.0). Of these, 1092 are viral enveloped or glycoprotein sequences (library file PVIRUSE1). Tables V through XIV contain lists of protein sequence names and motif hit locations for all the motifs searched.

10. EXAMPLE: COMPUTER-ASSISTED IDENTIFICATION OF DP107 AND DP178-LIKE SEQUENCES IN HUMAN IMMUNODEFICIENCY VIRUS

FIG. 20 represents search results for HIV-1 BRU isolate gp41 (PC/Gene protein sequence PENV_HV1BR). Notice that the hybrid motif which crosses DP-107 and DP-178 (named 107×178×4; the same motif as found in FIG. 16 found three hits including amino acids 550–599, 636–688, and 796–823. These areas include DP-107 plus eight N-terminal and four C-terminal amino acids; DP178 plus seven N-terminal and ten C-terminal amino acids; and an area inside the transmembrane region (cytoplasmic). FIG. 20 also contains the results obtained from searching with the motif named ALLMOTI5, for which the key is found in FIG. 17 ({CDGHP} {CFP}×5). This motif also found three hits including DP107 (amino acids 510–599), DP178 (615–717), and a cytoplasmic region (772–841). These hits overlap the hits found by the motif 107×178×4 with considerable additional sequences on both the amino and carboxy termini. This is not surprising in that 107×178×4 is a subset of the ALLMOTI5 hybrid motif. Importantly, even though the stringency of ALLMOTI5 is considerably less than 107×178×4, it sill selectively identifies the DP107 and DP178 regions of gp41 shown to contain sequences for inhibitory peptides of HIV-1. The results of these two motif searches are summarized in Table V of U.S. patent application Ser. No. 08/470,896 filed on Jun. 6, 1995 (incorporated herein by reference in its entirety) under the PC/Gene protein sequence name PENV_HV1BR. The proline-leucine zipper motifs also gave several hits in HIV-1 BRU including 503–525 which is at the very C-terminus of gp120, just upstream of the cleavage site (P7LZIPC and P12LZIPC); and 735–768 in the cytoplasmic domain of gp41 (P23LZIPC). These results are found in Tables VIII, IX, and X under the same sequence name as mentioned above. Notice that the only area of HIV-1 BRU which is predicted by the Lupas algorithm to contain a coiled-coil region, is from amino acids 635–670. This begins eight amino acids N-terminal to the start and ends eight amino acids N-terminal to the end of DP178. DP107, despite the fact that it is a known coiled coil, is not predicted to contain a coiled-coil region using the Lupas method.

11. EXAMPLE: COMPUTER-ASSISTED IDENTIFICATION OF DP107-LIKE AND DP178-LIKE SEQUENCES IN HUMAN RESPIRATORY SYNCYTIAL VIRUS

FIG. 21 represents search results for Human Respiratory Syncytial Virus (RSV; Strain A2) fusion glycoprotein F1 (PC/Gene protein sequence name PVGLF_HRSVA). Motif 107×178×4 finds three hits including amino acids 152–202, 213–243, and 488–515. The arrangement of these hits is similar to what is found in HIV-1 except that the motif finds two regions with similarities to DP-178, one just downstream of what would be called the DP107 region or amino acids 213–243, and one just upstream of the transmembrane region (also similar to DP178) or amino acids 488–515. Motif ALLMOTI5 also finds three areas including amino acids 116–202, 267–302, and 506–549. The proline-leucine zipper motifs also gave several hits including amino acids 205–221 and 265–287 (P1LZIPC 265–280, P12LZIPC), and 484–513 (P7LZIPC and P12LZIPC 484–506, P23LZIPC). Notice that the PLZIP motifs also identify regions which share location similarities with DP-178 of HIV-1.

12. EXAMPLE: COMPUTER-ASSISTED IDENTIFICATION OF DP107-LIKE AND DP178-LIKE SEUQENCES IN SIMIAN IMMUNODEFICIENCY VIRUS

Motif hits for Simian immunodeficiency Virus gp41 (AGM3 isolate; PC/Gene protein sequence name PENV_SIVAG) are shown in FIG. 22. Motif 107×178×4 finds three hits including amino acids 566–593, 597–624, and 703–730. The first two hits only have three amino acids between them and could probably be combined into one hit from 566–624 which would represent a DP107-like hit. Amino acids 703 to 730 would then represent a DP178-like hit. ALLMOTI5 also finds three hits including amino acids 556–628 (DP107-like), 651–699 (DP178-like), and 808–852 which represents the transmembrane spanning region. SIV also has one region from 655–692 with a high propensity to form a coiled coil as predicted by the Lupas algorithm. Both 107×178×4 and ALLMOTI5 motifs find the same region. SIV does not have any PLZIP motif hits in gp41.

The identification of DP178/DP107 analogs for a second SIV isolate (MM251) is demonstrated in the Example presented, below, in Section 19.

13. EXAMPLE: COMPUTER-ASSISTED IDENTIFICATION OF DP107-LIKE AND DP178 LIKE SEQUENCES IN CANINE DISTEMPER VIRUS

Canine Distemper Virus (strain Onderstepoort) fusion glycoprotein F1 (PC/Gene Protein sequence name PVGLF__CDVO) has regions similar to Human RSV which are predicted to be DP107-like and DP178-like (FIG. 23). Motif 107×178×4 highlights one area just C-terminal to the fusion peptide at amino acids 252–293. Amino acids 252–286 are also predicted to be coiled coil using the Lupas algorithm. Almost 100 amino acids C-terminal to the first region is a DP178-like area at residues 340–367. ALLMOTI5 highlights three areas of interest including: amino acids 228–297, which completely overlaps both the Lupas prediction and the DP107-like 107×178×4 hit; residues 340–381, which overlaps the second 107×178×4 hit; and amino acids 568–602, which is DP178-like in that it is located just N-terminal to the transmembrane region. It also overlaps another region (residues 570–602) predicted by the Lupas method to have a high propensity to form a coiled coil. Several PLZIP motifs successfully identified areas of interest including P6 and P12LZIPC which highlight residues 336–357 and 336–361 respectively; P1 and P12LZIPC which find residues 398–414; and P12 and P23LZIPC which find residues 562–589 and 562–592 respectively.

14. EXAMPLE: COMPUTER-ASSISTED IDENTIFICATION OF DP107-LIKE AND DP178-LIKE SEQUENCES IN NEWCASTLE DISEASE VIRUS

FIG. 24 shows the motif hits found in Newcastle Disease Virus (strain Australia-Victoria/32; PC Gene protein sequence name PVGLF__NDVA). Motif 107×178×4 finds two areas including a DP107-like hit at amino acids 151–178 and a DP178-like hit at residues 426–512. ALLMOTI5 finds three areas including residues 117–182, 231–272, and 426–512. The hits from 426–512 include a region which is predicted by the Lupas method to have a high coiled-coil propensity (460–503). The PLZIP motifs identify only one region of interest at amino acids 273–289 (P1 and 12LZIPC).

15. EXAMPLE: COMPUTER-ASSISTED IDENTIFICATION OF DP107-LIKE AND DP178-LIKE SEQUENCE IN HUMAN PARAINFLUENZA VIRUS

Both motifs 107×178×4 and ALLMOTI5 exhibit DP107-like hits in the same region, 115–182 and 117–182 respectively, of Human Parainfluenza Virus (strain NIH 47885; PC/Gene protein sequence name PVGLF__p13H4; (FIG. 25). In addition, the two motifs have a DP178-like hit just slightly C-terminal at amino acids 207–241. Both motifs also have DP178-like hits nearer the transmembrane region including amino acids 457–497 and 462–512 respectively. Several PLZIP motif hits are also observed including 283–303 (P5LZIPC), 283–310 (P12LZIPC), 453–474 (P6LZIPC), and 453–481 (P23LZIPC). The Lupas algorithm predicts that amino acids 122–176 may have a propensity to form a coiled-coil.

16. EXAMPLE: COMPUTER-ASSISTED IDENTIFICATION OF DP107-LIKE AND DP178-LIKE SEQUENCES OF INFLUENZA A VIRUS

FIG. 26 illustrates the Lupas prediction for a coiled coil in Influenza A Virus (strain A/Aichi/2/68) at residues 379–436, as well as the motif hits for 107×178×4 at amino acids 387–453, and for ALLMOTI5 at residues 380–456. Residues 383–471 (38–125 of HA2) were shown by Carr and Kim to be an extended coiled coil when under acidic pH (Carr and Kim, 1993, Cell 73: 823–832). The Lupas algorithm predicts a coiled-coil at residues 379–436. All three methods successfully predicted the region shown to actually have coiled-coil structure; however, ALLMOTI5 predicted the greatest portion of the 88 residue stretch.

17. EXAMPLE: POTENTIAL RESPIRATORY SYNCYTIAL VIRUS DP178/DP107 ANALOGS: CD AND ANTIVIRAL CHARACTERIZATION

In the Example presented herein, respiratory syncytial virus (RSV) peptides identified by utilizing the computer-assisted search motifs described in the Examples presented in Sections 9 and 11, above, were tested for anti-RSV activity. Additionally, circular dichroism (CD) structural analyses were conducted on the peptides, as discussed below. It is demonstrated that several of the identified peptides exhibit potent antiviral capability. Additionally, it is shown that several of these peptides exhibit a substantial helical character.

17.1 Materials and Methods

Structural Analyses:

The CD spectra were measured in a 10 mM sodium phosphate, 150 mM sodium chloride, pH 7.0, buffer at approximately 10 mM concentrations, using a 1 cm pathlength cell on a Jobin/Yvon Autodichrograph Mark V CD spectrophotometer. Peptides were synthesized according to the methods described, above, in Section 6.1. Peptide concentrations were determined from $A_{280}$ using Edlehoch's method (1967, Biochemistry 6:1948).

Anti-RSV Antiviral Activity Assays:

The assay utilized herein tested the ability of the peptides to disrupt the ability of HEp2 cells acutely infected with RSV (i.e., cells which are infected with a multiplicity of infection of greater than 2) to fuse and cause syncytial formation on a monolayer of uninfected an uninfected line of Hep-2 cells. The lower the observed level of fusion, the greater the antiviral activity of the peptide was determined to be.

Uninfected confluent monolayers of Hep-2 cells were grown in microtiter wells in 3% EMEM (Eagle Minimum Essential Medium w/o L-glutamine [Bio Whittaker Cat. No. 12-125F], with fetal bovine serum [FBS; which had been heat inactivated for 30 minutes at 56° C.; Bio Whittaker Cat. No. 14-501F) supplemented at 3%, antibiotics (penicillin/streptomycin; Bio Whittaker Cat. No. 17-602E) added at 1%, and glutamine added at 1%.

To prepare Hep2 cells for addition to uninfected cells, cultures of acutely infected Hep2 cells were washed with DPBS (Dulbecco's Phosphate Buffered Saline w/o calcium or magnesium; Bio Whittaker Cat. No. 17-512F) and cell monolayers were removed with Versene (1:5000; Gibco Life Technologies Cat. No. 15040-017). The cells were spun 10 minutes and resuspended in 3% FBS. Cell counts were performed using a hemacytometer. Persistent cells were added to the uninfected Hep-2 cells.

The antiviral assay was conducted by, first, removing all media from the wells containing uninfected Hep-2 cells, then adding peptides (at the dilutions described below) in 3% EMEM, and 100 acutely RSV-infected Hep2 cells per well. Wells were then incubated at 37° C. for 48 hours.

After incubation, cells in control wells were checked for fusion centers, media was removed from the wells, followed by addition, to each well, of either Crystal Violet stain or XTT. With respect to Crystal Violet, approximately 50 µl 0.25% Crystal Violet stain in methanol were added to each well. The wells were rinsed immediately, to remove excess stain, and were allowed to dry. The number of syncytia per well were then counted, using a dissecting microscope.

With respect to XTT (2,3-bis[2-Methoxy-4-nitro-5-sulfophenyl]-2H-tetrazolium-5-carboxyanilide inner salt), 50 µl XTT (1 mg/ml in RPMI buffered with 100 mM HEPES, pH 7.2–7.4, plus 5% DMSO) were added to each well. The $OD_{450/690}$ was measured (after blanking against growth medium without cells or reagents, and against reagents) according to standard procedures.

Peptides:

The peptides characterized in the study presented herein were:

1) peptides T-142 to T-155 and T-575, as shown in FIG. 27A, and peptides T-22 to T-27, T-68, T-334 and T-371 to T-375 and T-575, as shown in FIG. 27B;
2) peptides T-120 to T-141 and T-576, as shown in FIG. 27B, and peptides T-12, T-13, T-15, T-19, T-28 to T-30, T-66, T-69, T-70 and T-576, as shown in FIG. 27D; and
3) peptides T-67 and T-104 to T-119 and T-384, as shown in FIG. 28A, and peptides T-71, T-613 to T-617, T-662 to T-676 and T-730, as shown in FIG. 28B.

The peptides of group 1 represent portions of the RSV F2 protein DP178/107-like region. The peptides of group 2 represent portions of the RSV F1 protein DP107-like region. The peptides of groups 3 represent portions of the RSV F1 protein DP178-like region.

Each peptide was tested at 2-fold serial dilutions ranging from 100 µg/ml to approximately 100 ng/ml. For each of the assays, a well containing no peptide was also used. The $IC_{50}$ data for each peptide represents the average of several experiments conducted utilizing that peptide.

17.2 Results

The data summarized in FIGS. 27A–B and 28A–B represent antiviral and structural information obtained from peptides derived from the RSV F2 DP178/DP107-like F2 region (FIGS. 27A–B), the RSV F1 DP-107-like region (FIGS. 27C–D) and the RSV DP178-like F2 region (FIGS. 28A–B).

As shown in FIGS. 27A–D, a number of the RSV DP178/DP107-like peptides exhibited a detectable level of antiviral activity. Peptides from the RSV DP178/DP107-like F2 region (FIGS. 27A–B), for example, T-142 to T-145 and T-334 purfied peptides, exhibited detectable levels of antiviral activity, as evidenced by their $IC_{50}$ values. Further, a number of RSV F1 DP107-like peptides (FIGS. 27C–D) exhibited a sizable level of antiviral activity as purified peptides, including, for example, peptides T-124 to T-127, T-131, T-135 and T-137 to T-139, as demonstrated by their low $IC_{50}$ values. In addition, CD analysis FIGS. 27A, 27C) reveals that many of the peptides exhibit some detectable level of helical structure.

The results summarized in FIGS. 28A–B demonstrate that a number of DP178-like purified peptides exhibit a range of potent anti-viral activity. These peptides include, for example, T-67, T-104, T-105 and T-107 to T-119, as listed in FIG. 28A, and T-665 to T-669 and T-671 to T-673, as listed in FIG. 28B. In addition, some of the DP178-like peptides exhibited some level of helicity.

Thus, the computer assisted searches described, hereinabove, successfully identified viral peptide domains that represent highly promising anti-RSV antiviral compounds.

18. EXAMPLE: POTENTIAL HUMAN PARAINFLUENZA VIRUS TYPE 3 DP178/DP107 ANALOGS: CD AND ANTIVIRAL CHARACTERIZATION

In the Example presented herein, human parainfluenza virus type 3 (HPIV3) peptides identified by utilizing the computer-assisted search motifs described in the Examples presented in Sections 9 and 15, above, were tested for anti-HPIV3 activity. Additionally, circular dichroism (CD) structural analyses were conducted on the peptides, as discussed below. It is demonstrated that several of the identified peptides exhibit potent antiviral capability. Additionally, it is shown that several of these peptides exhibit a substantial helical character.

18.1 Materials and Methods

Structural Analyses:

Structural analyses consisted of circular dichroism (CD) studies. The CD spectra were measured in a 10 mM sodium phosphate, 150 mM sodium chloride, pH 7.0, buffer at approximately 10 mM concentrations, using a 1 cm pathlength cell on a Jobin/Yvon Autodichrograph Mark V CD spectrophotometer. Peptide concentrations were determined from $A_{280}$ using Edlehoch's method (1967, Biochemistry 6:1948).

Anti-HPIV3 Antiviral Activity Assays:

The assay utilized herein tested the ability of the peptides to disrupt the ability of Hep2 cells chronically infected with HPIV3 to fuse and cause syncytial formation on a monolayer of an uninfected line of CV-1W cells. The more potent the lower the observed level of fusion, the greater the antiviral activity of the peptide.

Uninfected confluent monolayers of CV-1W cells were grown in microtiter wells in 3% EMEM (Eagle Minimum Essential Medium w/o L-glutamine [Bio Whittaker Cat. No. 12-125F], with fetal bovine serum [FBS; which had been heat inactivated for 30 minutes at 56° C.; Bio Whittaker Cat. No. 14-501F) supplemented at 3%, antibiotics/antimycotics (Gibco BRL Life Technologies Cat. No. 15040-017) added at 1%, and glutamine added at 1%.

To prepare Hep2 cells for addition to uninfected cells, cultures of chronically infected Hep2 cells were washed with DPBS (Dulbecco's Phosphate Buffered Saline w/o calcium or magnesium; Bio Whittaker Cat. No. 17-512F) and cell monolayers were removed with Versene (1:5000; Gibco Life Technologies Cat. No. 15040-017). The cells were spun 10 minutes and resuspended in 3% FBS. Cell counts were performed using a hemacytometer. Persistent cells were added to the uninfected CV-1W cells.

The antiviral assay was conducted by, first, removing all media from the wells containing uninfected CV-1W cells, then adding peptides (at the dilutions described below) in 3% EMEM, and 500 chronically HPIV3-infected Hep2 cells per well. Wells were then incubated at 37° C. for 24 hours.

On day 2, after cells in control wells were checked for fusion centers, media was removed from the wells, followed by addition, to each well, of approximately 50 μl 0.25% Crystal Violet stain in methanol. Wells were rinsed immediately, to remove excess stain and were then allowed to dry. The number of syncytia per well were then counted, using a dissecting microscope.

Alternatively, instead of Crystal Violet analysis, cells were assayed with XTT, as described, avove, in Section 17.1.

Figure 29B:
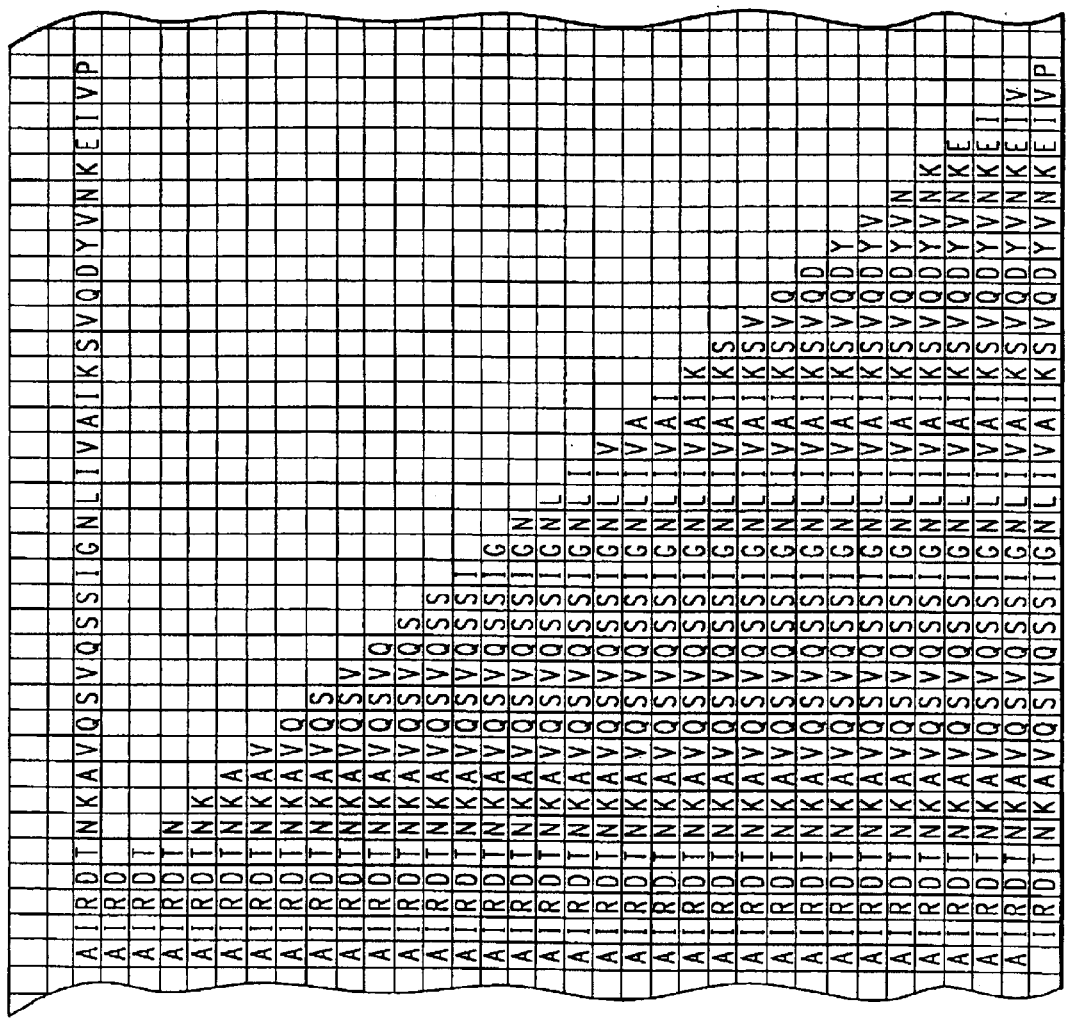
Figure 29E:
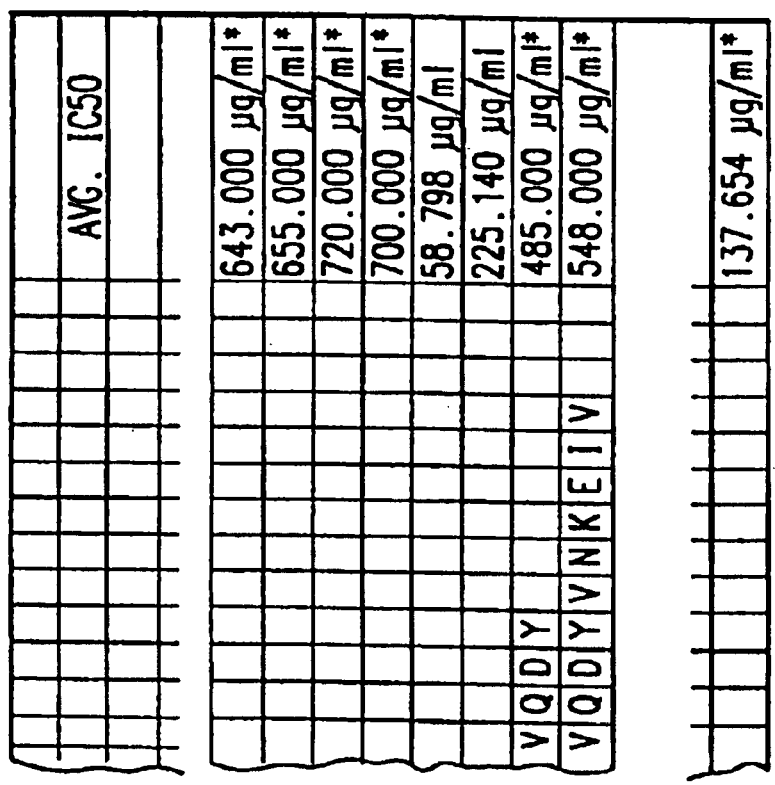

Peptides:

The peptides characterized in the study presented herein were:

1) Peptides 157 to 188, as shown in FIG. 29A, and peptides T-38 to T-40, T-42 to T-46 and T-582, as shown in FIG. 29B. These peptides are derived from the DP107 region of the HPIV3 F1 fusion protein (represented by HPF3 107, as shown in FIG. 29A); and 2) Peptides 189 to 210, as shown in FIG. 30A, and T-269, T-626, T-383 and T-577 to T-579, as shown in FIG. 30B. These peptides are primarily derived from the DP178 region of the HPIV3 F1 fusion protein (represented by HPF3 178, as shown in FIG. 30A). Peptide T-626 contains two mutated amino acid resides (represented by a shaded background). Additionally, peptide T-577 represents F1 amino acids 65–100, T-578 represents F1 amino acids 207–242 and T-579 represents F1 amino acids 273–309.

Each peptide was tested at 2-fold serial dilutions ranging from 500 μg/ml to approximately 500 ng/ml. For each of the assays, a well containing no peptide was also used.

18.2 Results

The data summarized in FIGS. 29A–C and 30A–B represent antiviral and structural information obtained from peptides derived from the HPIV3 fusion protein DP107-like region (FIGS. 29A–C) and the HPIV3 fusion protein DP178-like region (FIGS. 30A–B).

As shown in FIGS. 29A–B, a number of the HPIV3 DP107-like peptides exhibited potent levels of antiviral activity. These peptides include, for example, peptides T-40, T-172 to T-175, T-178, T-184 and T-185.

CD analysis reveals that a number of the peptides exhibit detectable to substantial level of helical structure. The CD spectra for one of the peptides, 184, which exhibits substantial helicity is summarized in FIG. 29C.

The results summarized in FIGS. 30A–B demonstrate that a number of the DP178-like peptides tested exhibit a range of anti-viral activity. These peptides include, for example, peptides 194 to 211, as evidenced by their low $IC_{50}$ values. In fact, peptides 201 to 205 exhibit $IC_{50}$ values in the nanogram/ml range. In addition, many of the DP178-like peptides exhibited some level of helicity.

Thus, the computer assisted searches described, hereinabove, have successfully identified viral peptide domains that represent highly promising anti-HPIV3 antiviral compounds.

19. EXAMPLE: COMPUTER-ASSISTED IDENTIFICATION OF DP178/DP107 ANALOGS IN SIMIAN IMMUNODEFICIENCY VIRUS

FIG. 31 represents search results for SIV isolate MM251 (PC/Gene® protein sequence PENV_SIVM2). Both 107×178×4 and ALLMOTI5 search motifs identified two regions with similarities to DP107 and/or DP178.

The peptide regions found by 107×178×4 were located at amino acid residues 156–215 and 277–289. The peptide regions found by ALLMOTI5 were located at amino acid residues 156–219 and 245–286. Both motifs, therefore, identify similar regions.

Interestingly, the first SIV peptide region (i.e., from amino acid residue 156 to approximately amino acid residue 219) correlates with a DP107 region, while the second region identified (i.e., from approximately amino acid residue 245 to approximately amino acid residue 289) correlates with the DP178 region of HIV. In fact, an alignment of SIV isolate MM251 and HIV isolate BRU, followed by a selection of the best peptide matches for HIV DP107 and DP178, reveals that the best matches are found within the peptide regions identified by the 107×178×4 and ALLMOTI5 search motifs.

It should be noted that a potential coiled-coil region at amino acid residues 242–282 is predicted by the Lupas program. This is similar to the observation in HIV in which the coiled-coil is predicted by the Lupas program to be in the DP178 rather than in the DP107 region. It is possible, therefore, that SIV may be similar to HIV in that it may contain a coiled-coil structure in the DP107 region, despite such a structure being missed by the Lupas algorithm. Likewise, it may be that the region corresponding to a DP178 analog in SIV may exhibit an undefined structure, despite the Lupas program's prediction of a coiled-coil structure.

20. EXAMPLE: COMPUTER-ASSISTED IDENTIFICATION OF DP178/DP107 ANALOGS IN EPSTEIN-BARR VIRUS

The results presented herein describe the identification of DP178/DP107 analogs within two different Epstein-Barr Virus proteins. Epstein-Barr is a human herpes virus which is the causative agent of, for example, infectious mononucleosis (IM), and is also associated with nasopharyngeal carcinomas (NPC), Burkitt's lymphoma and other diseases. The virus predominantly exists in the latent form and is activated by a variety of stimuli.

FIG. 32 depicts the search motif results for the Epstein-Barr Virus (Strain B95-8; PC/Gene® protein sequence PVGLB_EBV) glycoprotein gp110 precursor (gp115). The 107×178×4 motif identified two regions of interest, namely the regions covered by amino acid residues 95–122 and 631–658. One PZIP region was identified at amino acid residue 732–752 which is most likely a cytoplasmic region of the protein. The Lupas algorithm predicts a coiled-coil structure for amino acids 657–684. No ALLMOTI5 regions were identified.

FIG. 33 depicts the search motif results for the Zebra (or EB1) trans-activator protein (BZLF1) of the above-identified Epstein-Barr virus. This protein is a transcription factor which represents the primary mediator of viral reactivation. It is a member of the b-ZIP family of transcription factors and shares significant homology with the basic DNA-binding and dimerization domains of the cellular oncogenes c-fos and C/EBP. The Zebra protein functions as a homodimer.

Search results demonstrate that the Zebra protein exhibits a single region which is predicted to be either of DP107 or DP178 similarity, and is found between the known DNA binding and dimerization regions of the protein. Specifically, this region is located at amino acid residues 193–220, as shown in FIG. 33. The Lupas program predicted no coiled-coil regions.

21. EXAMPLE: COMPUTER-ASSISTED IDENTIFICATION OF DP178/DP107 ANALOGS IN MEASLES VIRUS

FIG. 34 illustrates the motif search results for the fusion protein F1 of measles virus, strain Edmonston (PC Gene® protein sequence PVGLF_MEASE), successfully identifying DP178/DP107 analogs.

The 107×178×4 motif identifies a single region at amino acid residues 228–262. The ALLMOTI5 search motif identifies three regions, including amino acid residues 116–184, 228–269 and 452–500. Three regions containing proline residues followed by a leucine zipper-like sequence were found beginning at proline residues 214, 286 and 451.

The Lupas program identified two regions it predicted had potential for coiled-coil structure, which include amino acid residues 141–172 and 444–483.

22. EXAMPLE: COMPUTER-ASSISTED IDENTIFICATION OF DP178/DP107 ANALOGS IN HEPATITIS B VIRUS

FIG. 35 depicts the results of a PZIP motif search conducted on the Hepatitis B virus subtype AYW. Two regions of interest within the major surface antigen precursor S protein were identified. The first lies just C-terminal to the proposed fusion peptide of the major surface antigen (Hbs) which is found at amino acid residues 174–191. The second region is located at amino acid residues 233–267. The Lupas program predicts no coiled-coil repeat regions.

In order to test the potential anti-HBV antiviral activity of these D178/DP107 analog regions, peptides derived from area around the analog regions are synthesized, as shown in FIGS. 52A–B. These peptides represent one amino acid peptide "walks" through the putative DP178/DP107 analog regions. The peptides are synthesized according to standard Fmoc chemistry on Rinkamide MBHA resins to provide for carboxy terminal blockade (Chang, C. D. and Meinhofer, J., 1978, Int. J. Pept. Protein Res. 11:246–249; Fields, G. B. and Noble, R. L., 1990, Int. J. Pept. Protein Res. 35:161–214). Follwing complete synthesis, the peptide amino-terminus is blocked through automated acetylation and the peptide is cleaved with trifluoroacetic acid (TFA) and the appropriate scavengers (King, D. S. et al., 1990, Int. J. Pept. Res. 36:255–266). After cleavage, the peptide is precipitated with ether and dried under vacuum for 24 hours.

The anti-HBV activity of the peptides is tested by utilizing standard assays to determine the test peptide concentration required to cause an acceptable (e.g., 90%) decrease in the amount of viral progeny formed by cells exposed to an HBV viral inoculum. Candidate antiviral peptides are further characterized in model systems such as wood chuck tissue culture and animal systems, prior to testing on humans.

23. EXAMPLE: COMPUTER-ASSISTED IDENTIFICATION OF DP178/DP107 ANALOGS IN SIMIAN MASON-PFIZER MONKEY VIRUS

The results depicted herein illustrate the results of search motifs conducted on the Simian Mason-Pfizer monkey virus. The motifs reveal DP178/DP107 analogs within the enveloped (TM) protein GP20, as shown in FIG. 36.

The 107×178×4 motifs identifies a region at amino acid residues 422–470. The ALLMOTI5 finds a region at amino acid residues 408–474. The Lupas program predicted a coiled-coil structure a amino acids 424–459.

24. EXAMPLE: COMPUTER-ASSISTED IDENTIFICATION OF DP178/DP107 ANALOGS IN BACTERIAL PROTEINS

The results presented herein demonstrate the identification of DP178/DP107 analogs corresponding to sequences present in proteins of a variety of bacterial species.

FIG. 37 depicts the search motif results for the *Pseudomonas aeruginosa* fimbrial protein (Pilin). Two regions were identified by motifs 107×178×4 and ALLMOTI5. The regions located at amino acid residues 30–67 and 80–144 were identified by the 107×178×4 motif. The regions at amino acid residues 30–68 and 80–125 were identified by the ALLMOTI5.

FIG. 38 depicts the search motif results for the *Pseudomonas gonorrhoeae* fimbrial protein (Pilin). A single region was identified by both the 107×178×4 and the ALLMOTI5 motifs. The region located at amino acid residues 66–97 was identified by the 107×178×4 motif. The region located at amino acid residues 66–125 were identified by the ALLMOTI5 search motif. No coiled-coil regions were predicted by the Lupas program.

FIG. 39 depicts the search motif results for the Hemophilus Influenza fimbrial protein (Pilin). A single region was identified by both the 107×178×4 and the ALLMOTI5 motifs. The region located at amino acid residues 102–129 was identified by the 107×178×4 motif. The region located at amino acid residues 102–148 were identified by the ALLMOTI5 search motif. No coiled-coil regions were predicted by the Lupas program.

FIG. 40 depicts the search motif results for the *Staphylococcus aureus* toxic shock syndrome Hemophilus Influenza fimbrial protein (Pilin). A single region was identified by both the 107×178×4 and the ALLMOTI5 motifs. The region located at amino acid residues 102–129 was identified by the 107×178×4 motif. The region located at amino acid residues 102–148 were identified by the ALLMOTI5 search motif. No coiled-coil regions were predicted by the Lupas program.

FIG. 41 summarizes the motif search results conducted on the *Staphylococcus aureus* enterotoxin Type E protein. These results demonstrate the successful identification of DP178/DP107 analogs corresponding to peptide sequences within this protein, as described below.

The ALLMOTI5 motif identified a region at amino acid residues 22–27. The 107×178×4 motif identified two regions, with the first at amino acid residues 26–69 and the second at 88–115. A P12LZIPC motif search identified two regions, at amino acid residues 163–181 and 230–250.

The Lupas program predicted a region with a high propensity for coiling at amino acid residues 25–54. This sequence is completely contained within the first region identified by both ALLMOTI5 and 107×178×4 motifs.

FIG. 42 depicts the search motif results conducted on a second *Staphylococcus aureus* toxin, enterotoxin A. Two regions were identified by the ALLMOTI5 motif, at amino acid residues 22–70 and amino acid residues 164–205. The 107×178×4 motif found two regions, the first at amino acid residues 26–69 and the second at amino acid residues 165–192. A P23LZIPC motif search revealed a region at amino acid residues 216–250. No coiled-coil regions were predicted by the Lupas program.

FIG. 43 shows the motif search results conducted on the *E. coli* heat labile enterotoxin A protein, demonstrating that identification of DP178/DP107 analogs corresponding to peptides located within this protein. Two regions were identified by the ALLMOTI5 motif, with the first residing at amino acid residues 55–115, and the second residing at amino acid residues 216–254. The 107×178×4 motif identified a single region at amino acid residues 78–105. No coiled-coil regions were predicted by the Lupas program.

25. EXAMPLE: COMPUTER-ASSISTED IDENTIFICATION OF DP178/DP107 ANALOGS WITHIN VARIOUS HUMAN PROTEINS

The results presented herein demonstrate the identification of DP178/DP107 analogs corresponding to peptide sequences present within several different human proteins.

FIG. 44 illustrates the search motif results conducted on the human c-fos oncoprotein. The ALLMOTI5 motif identified a single region at amino acid residues 155–193. The 107×178×4 motif identified one region at amino acid residues 162–193. The Lupas program predicted a region at amino acid residues 148–201 to have coiled-coil structure.

FIG. 45 illustrates the search motif results conducted on the human lupus KU autoantigen protein P70. The ALLMOTI5 motif identified a single region at amino acid residues 229–280. The 107×178×4 motif identified one region at amino acid residues 235–292. The Lupas program predicted a region at amino acid residues 232–267 to have coiled-coil structure.

FIG. 46 illustrates the search motif results conducted on the human zinc finger protein 10. The ALLMOTI5 motif identified a single region at amino acid residues 29–81. The 107×178×4 motif identified one region at amino acid residues 29–56. A P23LZIPC motif search found a single region at amino acid residues 420–457. The Lupas program predicted no coiled-coil regions.

26. EXAMPLE: POTENTIAL MEASLES VIRUS DP178/DP107 ANALOGS: CD AND ANTIVIRAL CHARACTERIZATION

In the Example presented herein, measles (MeV) virus DP178-like peptides identified by utilizing the computer-assisted search motifs described in the Examples presented in Sections 9 and 21, above, are tested for anti-MeV activity. Additionally, circular dichroism (CD) structural analyses are conducted on the peptides, as discussed below. It is demonstrated that several of the identified peptides exhibit potent antiviral capability. Additionally, it is shown that none of these peptides exhibit a substantial helical character.

26.1 Materials and Methods

Structural analyses: The CD spectra were measured in a 10 mM sodium phosphate, 150 mM sodium chloride, pH 7.0, buffer at approximately 10 mM concentrations, using a 1 cm pathlength cell on a Jobin/Yvon Autodichrograph Mark V CD spectrophotometer. Peptide concentrations were determined from $A_{280}$ using Edlehoch's method (1967, Biochemistry 6:1948).

Anti-MeV antiviral activity syncytial reduction assay: The assay utilized herein tested the ability of the peptides to disrupt the ability of Vero cells acutely infected with MeV (i.e., cells which are infected with a multiplicity of infection of 2–3) to fuse and cause syncytial formation on a monolayer of an uninfected line of Vero cells. The more potent the peptide, the lower the observed level of fusion, the greater the antiviral activity of the peptide.

Uninfected confluent monolayers of Vero cells were grown in microtiter wells in 10% FBS EMEM (Eagle Minimum Essential Medium w/o L-glutamine [Bio Whittaker Cat. No. 12-125F], with fetal bovine serum [FBS; which had been heat inactivated for 30 minutes at 56° C.; Bio Whittaker Cat. No. 14-501F) supplemented at 10%, antibiotics/antimycotics (Bio Whittaker Cat. No. 17-602E) added at 1%, and glutamine added at 1%.

To prepare acutely infected Vero cells for addition to the uninfected cells, cultures of acutely infected Vero cells were washed twice with HBSS (Bio Whittaker Cat. No. 10-543F) and cell monolayers were removed with trypsin (Bio Whittaker Cat. No. 17-161E). Once cells detached, media was added, any remaining clumps of cells were dispersed, and hemacytometer cell counts were performed.

The antiviral assay was conducted by, first, removing all media from the wells containing uninfected Vero cells, then adding peptides (at the dilutions described below) in 10% FBS EMEM, and 50–100 acutely MeV-infected Vero cells per well. Wells were then incubated at 37° C. for a maximum of 18 hours.

On day 2, after cells in control wells were checked for fusion centers, media was removed from the wells, followed by addition, to each well, of approximately 50 μl 0.25% Crystal Violet stain in methanol. Wells were rinsed twice with water immediately, to remove excess stain and were then allowed to dry. The number of syncytia per well were then counted, using a dissecting microscope.

Anti-MeV antiviral activity plaque reduction assay: The assay utilized herein tested the ability of the peptides to disrupt the ability of MeV to infect permissive, uninfected Vero cells, leading to the infected cells' fusing with uninfected cells to produce syncytia. The lower the observed level of syncytial formation, the greater the antiviral activity of the peptide.

Monolayers of uninfected Vero cells are grown as described above.

The antiviral assay was conducted by, first, removing all media from the wells containing uninfected Vero cells, then adding peptides (at the dilutions described below) in 10% FBS EMEM, and MeV stock virus at a final concentration of 30 plaque forming units (PFU) per well. Wells were then incubated at 37° C. for a minimum of 36 hours and a maximum of 48 hours.

On day 2, after cells in control wells were checked for fusion centers, media was removed from the wells, followed by addition, to each well, of approximately 50 μl 0.25% Crystal Violet stain in methanol. Wells were rinsed twice with water immediately, to remove excess stain and were then allowed to dry. The number of syncytia per well were then counted, using a dissecting microscope.

Peptides: The peptides characterized in the study presented herein were peptides T-252A0 to T-256A0, T-257B1/C1, and T-258B1 to T-265B0, and T-266A0 to T-268A0, as shown in FIG. 47. These peptides represent a walk through the DP178-like region of the MeV fusion protein.

Each peptide was tested at 2-fold serial dilutions ranging from 100 μg/ml to approximately 100 ng/ml. For each of the assays, a well containing no peptide was also used.

26.2 Results

The data summarized in FIG. 47 represents antiviral and structural information obtained via "peptide walks" through the DP178-like region of the MeV fusion protein.

As shown in FIG. 47, the MeV DP178-like peptides exhibited a range of antiviral activity as crude peptides. Several of these peptides were chosen for purification and further antiviral characterization. The $IC_{50}$ values for such peptides were determined, as shown in FIG. 47, and ranged from 1.35 μg/ml (T-257B1/C1) to 0.072 μg/ml (T-265B1). None of the DP178-like peptides showed, by CD analysis, a detectable level of helicity.

Thus, the computer assisted searches described, hereinabove, as in for example, the Example presented in Section 9, for example, successfully identified viral peptide domains that represent highly promising anti-MeV antiviral compounds.

27. EXAMPLE: POTENTIAL SIV DP178/DP107 ANALOGS: ANTIVIRAL CHARACTERIZATION

In the Example presented herein, simian immunodeficiency virus (SIV) DP178-like peptides identified by utilizing the computer-assisted search motifs described in the Examples presented in Sections 9, 12 and 19, above, were tested for anti-SIV activity. It is demonstrated that several of the identified peptides exhibit potent antiviral capability.

27.1 Materials and Methods

Anti-SIV antiviral assays: The assay utilized herein were as reported in Langolis et al. (Langolis, A. J. et al., 1991, AIDS Research and Human Retroviruses 7:713–720).

Peptides: The peptides characterized in the study presented herein were peptides T-391 to T-400, as shown in FIG. 48. These peptides represent a walk through the DP178-like region of the SIV TM protein.

Each peptide was tested at 2-fold serial dilutions ranging from 100 µg/ml to approximately 100 ng/ml. For each of the assays, a well containing no peptide was also used.

27.2 Results

The data summarized in FIG. 48 represents antiviral information obtained via "peptide walks" through the DP178-like region of the SIV TM protein.

As shown in FIG. 48, peptides T-391 to T-400 were tested and exhibited a potent antiviral activity as crude peptides.

Thus, the computer assisted searches described, hereinabove, as in for example, the Example presented in Section 9, for example, successfully identified viral peptide domains that represent highly promising anti-SIV antiviral compounds.

28. EXAMPLE: ANTI-VIRAL ACTIVITY OF DP107 and DP-178 PEPTIDE TRUNCATIONS AND MUTATIONS The Example presented in this Section represents a study of the antiviral activity of DP107 and DP178 truncations and mutations. It is demonstrated that several of these DP107 and DP178 modified peptides exhibit substantial antiviral activity.

28.1 Materials and Methods

Anti-HIV assays: The antiviral assays performed were as those described, above, in Section 6.1. Assays utilized HIV-1/IIIb and/or HIV-2 NIHZ isolates. Purified peptides were used, unless otherwise noted in FIGS. 49A–C.

Peptides: The peptides characterized in the study presented herein were:

1) FIGS. 49A–C present peptides derived from the region around and containing the DP178 region of the HIV-1 BRU isolate. Specifically, this region spanned from gp41 amino acid residue 615 to amino acid residue 717. The peptides listed contain truncations of this region and/or mutations which vary from the DP178 sequence amino acid sequence. Further, certain of the peptides have had amino- and/or carboxy-terminal groups either added or removed, as indicated in the figures; and 2) FIG. 50 presents peptides which represent truncations of DP107 and/or the gp41 region surrounding the DP107 amino acid sequence of HIV-1 BRU isolate. Certain of the peptides are unblocked or biotinylated, as indicated in the figure.

Blocked peptides contained an acyl N-terminus and an amido C-terminus.

28.2 Results

Anti-HIV antiviral data was obtained with the group 1 DP178-derived peptides listed in FIGS. 49A–C. The full-length, non-mutant DP178 peptide (referred to in FIGS. 49A–C as T20) results shown are for 4 ng/ml.

In FIG. 49A, a number of the DP178 truncations exhibited a high level of antiviral activity, as evidenced by their low $IC_{50}$ values. These include, for example, test peptides T-50, T-624, T-636 to T-641, T-645 to T-650, T-652 to T-654 and T-656. T-50 represents a test peptide which contains a point mutation, as indicated by the residue's shaded background. The HIV-1-derived test peptides exhibited a distinct strain-specific antiviral activity, in that none of the peptides tested on the HIV-2 NIHZ isolate demonstrated appreciable antti-HIV-2 antiviral activity.

Among the peptides listed in FIG. 49B, are test peptides representing the amino (T-4) and carboxy (T-3) terminal halves of DP178 were tested. The amino terminal peptide was not active ($IC_{50}$>400 µg/ml) whereas the carboxy terminal peptide showed potent antiviral activity ($IC_{50}$=3 µg/ml). A number of additional test peptides also exhibited a high level of antiviral activity. These included, for example, T-61/T-102, T-217 to T-221, T-235, T-381, T-677, T-377, T-590, T-378, T-591, T-271 to T-272, T-611, T-222 to T-223 and T-60/T-224. Certain of the antiviral peptides contain point mutations and/or amino acid residue additions which vary from the DP178 amino acid sequence.

In FIG. 49C, point mutations and/or amino and/or carboxy-terminal modifications are introduced into the DP178 amino acid sequence itself. As shown in the figure, the majority of the test peptides listed exhibit potent antiviral activity.

Truncations of the DP107 peptide (referred to in IG. 50 as T21) were also produced and tested, as shown in FIG. 50. FIG. 50 also presents data concerning blocked and unblocked peptides which contain additional amino acid residues from the gp41 region in which the DP107 sequence resides. Most of these peptides showed antiviral activity, as evidenced by their low $IC_{50}$ values.

Thus, the results presented in this Section demonstrate that not only do the full length DP107 and DP178 peptides exhibit potent antiviral activity, but truncations and/or mutant versions of these peptides can also possess substantial antiviral character.

29. EXAMPLE: POTENTIAL EPSTEIN-BARR DP178/DP107 ANALOGS: ANTIVIRAL CHARACTERIZATION

In the Example presented herein, peptides derived from the Epstein-Barr (EBV) DP-178/DP107 analog region of the Zebra protein identified, above, in the Example presented in Section 20 are described and tested for anti-EBV activity. It is demonstrated that among these peptides are one which exhibit potential anti-viral activity.

29.1 Materials and Methods

Electrophoretic Mobility Shift Assays (EMSA): Briefly, an EBV Zebra protein was synthesized utilizing SP6 RNA polymerase in vitro transcription and wheat germ in vitro translation systems (Promega Corporation recommendations; Butler, E. T. and Chamberlain, M. J., 1984, J. Biol. Chem. 257:5772; Pelham, H. R. B. and Jackson, R. J., 1976, Eur. J. Biochem. 67:247). The in vitro translated Zebra protein was then preincubated with increasing amounts of peptide up to 250 ng/ml prior to the addition of 10,000 to 20,000 c.p.m. of a $^{32}$P-labeled Zebra response element DNA fragment. After a 20 minute incubation in the presence of the response element, the reaction was analyzed on a 4% non-denaturing polyacrylamide gel, followed by autoradiography, utilizing standard gel-shift procedures. The ability of a test peptide to prevent Zebra homodimer DNA binding was assayed by the peptide's ability to abolish the response element gel migration retardation characteristic of a protein-bound nucleic acid molecule.

Peptides: The peptides characterized in this study represent peptide walks through the region containing, and flanked on both sides by, the DP178/DP107 analog region identified in the Example presented in Section 20, above, and shown as shown in FIG. 33. Specifically, the peptide walks covered the region from amino acid residue 173 to amino acid residue 246 of the EBV Zebra protein.

Each of the tested peptides were analyzed at a range of concentrations, with 150 ng/ml being the lowest concentration at which any of the peptides exerted an inhibitory effect.

29.2 Results

The EBV Zebra protein transcription factor contains a DP178/DP107 analog region, as demonstrated in the Example presented, above, in Section 20. This protein appears to be the primary factor responsible for the reactivation capability of the virus. A method by which the DNA-binding function of the Zebra virus may be abolished may, therefore, represent an effective antiviral technique. In order to identify potential anti-EBV DP178/DP107 peptides, therefore, peptides derived from the region identified in Section 20, above, were tested for their ability to inhibit Zebra protein DNA binding.

The test peptides' ability to inhibit Zebra protein DNA binding was assayed via the EMSA assays described, above, in Section 28.1. The data summarized in FIGS. 51A–B presents the results of EMSA assays of the listed EBV test peptides. These peptides represent one amino acid "walks" through the region containing, and flanked on both sides by, the DP178/DP107 analog region identified in the Example presented in Section 20, above, and shown as shown in FIG. 33. As shown in FIGS. 51A–B, the region from which these peptides are derived lies from EBV Zebra protein amino acid residue 173 to 246. A number of the test peptides which were assayed exhibited an ability to inhibit Zebra protein homodimer DNA binding, including 439, 441, 444 and 445.

Those peptides which exhibit an ability to inhibit Zebra protein DNA binding represent potential anti-EBV antiviral compounds whose ability to inhibit EBV infection can be further characterized.

30. EXAMPLE: IDENTIFICATION OF RSV DP107/DP178 ANALOGS WITH REDUCED BINDING AFFINITY

In the example presented herein, peptides derived from the RSV DP178 analog T112 are described and tested for binding affinity to the DP107-like domain of the RSV F1-protein. Particular peptides are identified that have a reduced binding affinity for their DP107-like target, and key amino acid residues are identified the confer high binding affinity to the native peptide (i.e., to T112). Such peptides are useful, e.g., in screening assays such as those described above in Section 5.6.1 to identify compounds which inhibit or disrupt the interaction between DP107 and DP178, and in providing guidance for generation of additional peptides exhibiting reduced affinity binding.

30.1 Materials and Methods

A maltose binding fusion protein of the RSV F1-protein (MF5.1) was constructed using methods similar to those described in Section 8.1.2, supra, for construction of the M41 fusion protein. Specifically, the DNA sequence corresponding amino acid residues 142–302 of the RSV F1 protein was amplified by PCR and cloned into the Xmn I site of the expression vector pMal-p2 (New England Biolab) to give MF5.1. These amino acid residues correspond to the extracellular domain of the RSV F1 protein including its DP107 region but excluding the DP178 region.

The peptides characterized in the study presented herein were: T122, T800, T801, T802, T803, T804, T805, T806, T807, T808, T809, T810, T811, T1669, T1670, T1671, T1672, T1673, T1680, T1681, T1682, T1683 and T1684, as shown in FIG. 53. T112 represents the DP178-like region of the RSV F1 protein. The other peptides characterized are modified DP178 proteins derived from T112.

Cell fusion assays were performed with each of the peptides as described in Section 17 above. The binding affinity of each peptide was also measured in a competitive binding assay described in Section 5.6.1 above, wherein the concentration of each peptide necessary to bind to the M5.1 fusion protein (i.e., the $B_{50}$ value), and thereby disrupt binding of biotin labeled T112 (T888) to the fusion protein, was measured.

30.2 Results

T112 is a 35 amino acid residue peptide that corresponds to amino acid residues 482–516 of the RSV F1 protein and has the following amino acid sequence:

VFPSDEFDASISQVNEKINQSLAFIRKSDELLHNV

The peptide represents the DP178-like region of the RSV F1 protein and has substantial antiviral activity against RSV as discussed in Section 17.2 above and shown in FIG. 28A.

T112 analogs were generated according to at least three different strategies to generate peptides based on T112 that would still bind to the DP107-like domain of the RSV F1 protein but with a lower binding affinity. First, a truncated peptide was generated, reducing the length of the peptide from 35 to 28 amino acid residues. Specifically, the truncated peptide, which is referred to herein as T67, had the amino acid sequence:

DEFDASISQVNEKINQSLAFIRKSDELL corresponding to amino acid residues 486–213 of the F1 fusion protein. The binding affinity of the peptide to the DP107-like domain of F1 protein was determined according to the methods described in Section 5.6.1 above. The truncated peptide had a binding affinity (5 nM) that was five times lower than that of the full length T112 peptide (2 nM).

As part of a second strategy, the peptides identified as T800 through T811 in FIG. 53 were synthesized to identify particular amino acids in T112 that contribute to a larger part of that peptide's binding affinity. As a whole, these alanine substitutions represent an "alanine-scanning" type walk across the sequence of T112.

Each of the peptides synthesized has a change of three consecutive amino acid residues in the T112 sequence to three alanine residues. Each peptide was tested for its ability to inhibit the binding of the native peptide (i.e., of T112) in a competitive binding assay as described in Section 5.6.1 above. The results are also shown in FIG. 53. In particular, the peptides T802, T804, T807 and T810 had significantly reduced affinity for the DP107-like target, suggesting that the regions containing amino acid residues 488–490, 494–496, 503–505 and 512–514 of the RSV F1 protein (amino acid residues 7–9, 13–15, 22–24 and 31–33, respectively, of T112), contribute significantly to the high binding affinity of T112 for its DP107-like target in the RSV F1 protein.

The peptides T1669-T1673 and T1680 through T1684 were then synthesized, each of which contains a single alanine substitution at one of the above-listed amino acid residue positions of T112. The binding affinity of these peptides for their DP107-like target can also be determined by means of the same routine screening assays, thereby identifying individual amino acid residues which affect binding affinity of T112.

In addition, an additional novel peptide, referred to as T786, was generated by modifying various amino acid residues in the T112 sequence which were identified, using standard principles of protein and design, as affecting properties such as binding affinity, solubility and biological stability. Specifically the following amino acid residue substitutions were made: $F_2 \rightarrow Y$, $S_{21} \rightarrow A$, $F_{24} \rightarrow Y$ and $S_{28} \rightarrow A$, wherein the subscript numerals indicate the amino acid residue position in T112. The resultant peptide, which is referred to herein as T786, thus had the amino acid sequence:

VYPSDEFDASISQVNEKINQALAYIRKADELLHNV

The binding affinity of this novel peptide for the DP107 target was found to be 19 nM, i.e., approximately ten-fold less than the binding affinity of T112.

The data demonstrates that peptides having a reduced binding affinity for a DP107 target (i.e., for an HR1 domain) may be readily found by modifying a DP178 peptide such as T112, e.g., by means of the routine techniques and assays described herein. Further, the techniques and assays identify key amino acid residues which may be used to construct and identify other reduced affinity peptides.

31. EXAMPLE: IDENTIFICATION OF HIV DP107/DP178 ANALOGS WITH REDUCED BINDING AFFINITY

In the example presented herein, peptides derived from DP178, which is also referred to as T20, are described and tested for binding affinity to the DP107 domain of the HIV gp41. Particular peptides are identified that have a reduced binding affinity for their DP107 target, and key amino acid residues are identified the confer high binding affinity to the native peptide (i.e., to T20). Such peptides are useful, e.g., in screening assays such as those described above in Section 5.6.1 to identify compounds which inhibit or disrupt the interaction between DP107 and DP178.

Specifically, the peptides identified as T813 and T868 through T878 in FIG. 53 were synthesized to identify particular amino acids in T20 (DP178) that contribute to a greater part of that peptide's binding affinity. Each of the peptides synthesized has a change of three consecutive amino acid residues in the T20 sequence to three alanine residues. The antiviral activity of each peptide was assayed in cell fusion assays as described in Section 6.1.3, above. The binding affinities of the peptides were also measured in a competitive binding assay described in Section 5.6.1 above, wherein each peptides ability to disrupt the binding of either biotin (T83) or fluorescein (T1342) labeled DP178 (T20) to the M41Δ178 fusion protein described in Section 8, above, was measured. The binding affinity of each peptide to the peptide referred to as T764 (GSTMGARSMTLTVQARQLLSGIVQQNNLLRAIEAQQH) also measured using circular dichroism to monitor the amount of secondary structure (i.e., helicity) adopted by the peptides. T764 is a peptide which represents the DP107 target domain of DP178 (T20).

The results are provided in FIG. 54. In particular, the peptides T813, T878, T874–T876 and T871 have significantly reduced affinity for the DP107 region, suggesting the regions corresponding to the substituted amino acid residues in those peptides contribute significantly to the high binding affinity of T20. The peptides T1627–T1632, T1650–T1653 and T1656–T1665 were then synthesized. Each of these peptides contains a single alanine substitution at one of the amino acid residues in one of the regions identified as contributing significantly to the high binding affinity of T20. Identical assays which measured the binding affinity of these peptides identified four essential residues ($I_{646}$, $Q_{652}$, $Q_{653}$ and $N_{656}$, with the subscript numerals indicating the residue position in the HIV-$1_{LAI}$ gp41 amino acid sequence) in which alanine-substitution completely prevented binding to the DP107 domain, as well as five residues ($L_{641}$, $I_{642}$, $I_{645}$, $E_{657}$ and $L_{663}$, with the subscript numerals indicating the residue) in which alanine-substitution position in the HIV-$1_{LAI}$ gp41 amino acid sequence) that reduced the binding affinity but did not actually block binding to the DP107 domain.

The data demonstrates that peptides having a reduced binding affinity for a DP107 target (i.e., for an HR1 domain) may be readily found by modifying a DP178 peptide such as T20, e.g., by means of the routine techniques and assays described herein. Further, the techniques and assays identify key amino acid residues which may be used to construct and identify other reduced affinity peptides.

The present invention is not to be limited in scope by the specific embodiments described which are intended as single illustrations of individual aspects of the invention, and functionally equivalent methods and components are within the scope of the invention. Indeed, various modifications of the invention, in addition to those shown and described herein will become apparent to those skilled in the art from the foregoing description and accompanying drawings. Such modifications are intended to fall within the scope of the appended claims.

SEQUENCE LISTING (1946 sequences)

SEQ ID NO: 1 - protein, 19 aa, Artificial Sequence
  Core polypeptide
GIKQLQARILAVERYLKDQ

SEQ ID NO: 2 - protein, 19 aa, Artificial Sequence
  Core polypeptide
NNLLRAIEAQQHLLQLTVW

SEQ ID NO: 3 - protein, 18 aa, Artificial Sequence
  Core polypeptide
NEQELLELDKWASLWNWF

SEQ ID NO: 4 - protein, 18 aa, Artificial Sequence
  Core polypeptide
YTSLIHSLIEESQNQQEK

SEQ ID NO: 5 - protein, 28 aa, Artificial Sequence
  Core polypeptide
VWGIKQLQARILAVERYLKDQQLLGIWG

SEQ ID NO: 6 - protein, 28 aa, Artificial Sequence
  Core polypeptide
QHLLQLTVWGIKQLQARILAVERYLKDQ

SEQ ID NO: 7 - protein, 28 aa, Artificial Sequence
  Core polypeptide
LRAIEAQQHLLQLTVWGIKQLQARILAV

SEQ ID NO: 8 - protein, 28 aa, Artificial Sequence
  Core polypeptide
VQQQNNLLARIEAQQHLLQLTVWGIKQL

SEQ ID NO: 9 - protein, 28 aa, Artificial Sequence
  Core polypeptide
RQLLSGIVQQQNNLLRAIEAQQHLLQLT

SEQ ID NO: 10 - protein, 28 aa, Artificial Sequence
  Core polypeptide
MTLTVQARQLLSGIVQQQNNLLRAIEAQ

SEQ ID NO: 11 - protein, 27 aa, Artificial Sequence
  Core polypeptide
VVSLSNGVSVLTSKVLDLKNYIDKQLL

SEQ ID NO: 12 - protein, 28 aa, Artificial Sequence
  Core polypeptide
LLSTNKAVVSLSNGVSVLTSKVLDLKNY

SEQ ID NO: 13 - protein, 28 aa, Artificial Sequence
  Core polypeptide
VLHLEGEVNKIKSALLSTNKAVVSLSNG

SEQ ID NO: 14 - protein, 28 aa, Artificial Sequence
  Core polypeptide
LLSTNKAVVSLSNGVSVLTSKVLDLKNY

SEQ ID NO: 15 - protein, 36 aa, Artificial Sequence
  Core polypeptide
YTSLIHSLIEESQNQQEKNEQELLELDKWASLWNWF

SEQ ID NO: 16 - protein, 38 aa, Artificial Sequence
  Core polypeptide
NNLLRAIEAQQHLLQLTVWGIKQLQARILAVERYLKDQ

SEQ ID NO: 17 - protein, 42 aa, Artificial Sequence
  Core polypeptide
IELSNIKENKCNGTDAKVKLIKQELDKYKNAVTELQLLMQST

SEQ ID NO: 18 - protein, 28 aa, Artificial Sequence
  Core polypeptide
IELSNIKENKCNGTDAKVKLIKQELDKY

SEQ ID NO: 19 - protein, 28 aa, Artificial Sequence
  Core polypeptide
ENKCNGTDAKVKLIKQELDKYKNAVTEL

SEQ ID NO: 20 - protein, 28 aa, Artificial Sequence
  Core polypeptide
DAKVKLIKQELDKYKNAVTELQLLMQST

SEQ ID NO: 21 - protein, 28 aa, Artificial Sequence
  Core polypeptide
CNGTDAKVKLIKQELDKYKNAVTELQLL

SEQ ID NO: 22 - protein, 35 aa, Artificial Sequence
  Core polypeptide
SNIKENKCNGTDAKVKLIKQELDKYKNAVTELQLL

SEQ ID NO: 23 - protein, 37 aa, Artificial Sequence
  Core polypeptide
ASGVAVSKVLHLEGEVNKIKSALLSTNKAVVSLSNGV

SEQ ID NO: 24 - protein, 35 aa, Artificial Sequence
  Core polypeptide
SGVAVSKVLHLEGEVNKIKSALLSTNKAVVSLSNG

SEQ ID NO: 25 - protein, 35 aa, Artificial Sequence
  Core polypeptide
VLHLEGEVNKIKSALLSTHKAVVSLSNGVSVLTSK

SEQ ID NO: 26 - protein, 36 aa, Artificial Sequence
  Core polypeptide
ARKLQRMKQLEDKVEELLSKNYHYLENEVARLKKLV

SEQ ID NO: 27 - protein, 34 aa, Artificial Sequence
  Core polypeptide
RMKQLEDKVEELLSKNYHYLENEVARLKKLVGER

SEQ ID NO: 28 - protein, 28 aa, Artificial Sequence
  Core polypeptide
VQQQNNLLRAIEAQQHLLQLTVWGIKQL

SEQ ID NO: 29 - protein, 28 aa, Artificial Sequence
  Core polypeptide
LRAIEAQQHLLQLTVWGIKQLQARILAV

SEQ ID NO: 30 - protein, 28 aa, Artificial Sequence
  Core polypeptide
QHLLQLTVWGIKQLQARILAVERYLKDQ

SEQ ID NO: 31 - protein, 28 aa, Artificial Sequence
  Core polypeptide
RQLLSGIVQQQNNLLRAIEAQQHLLQLT

SEQ ID NO: 32 - protein, 28 aa, Artificial Sequence
  Core polypeptide
MTLTVQARQLLSGIVQQQNNLLRAIEAQ

SEQ ID NO: 33 - protein, 28 aa, Artificial Sequence
  Core polypeptide
AKQARSDIEKLKEAIRDTNKAVQSVQSS

SEQ ID NO: 34 - protein, 35 aa, Artificial Sequence
  Core polypeptide
AAVALVEAKQARSDIEKLKEAIRDTNKAVQSVQSS

SEQ ID NO: 35 - protein, 35 aa, Artificial Sequence
  Core polypeptide
AKQARSDIEKLKEAIRDTNKAVQSVQSSIGNLIVA

SEQ ID NO: 36 - protein, 28 aa, Artificial Sequence
  Core polypeptide
GTIALGVATSAQITAAVALVEAKQARSD

SEQ ID NO: 37 - protein, 28 aa, Artificial Sequence
  Core polypeptide
ATSAQITAAVALVEAKQARSDIEKLKEA

SEQ ID NO: 38 - protein, 28 aa, Artificial Sequence
  Core polypeptide
AAVALVEAKQARSDIEKLKEAIRDTNKA

SEQ ID NO: 39 - protein, 35 aa, Artificial Sequence
  Core polypeptide
IDISIELNKAKSDLEESKEWIEKSNQELDSIGNWE

SEQ ID NO: 40 - protein, 28 aa, Artificial Sequence
  Core polypeptide
IEKLKEAIRDTNKAVQSVQSSIGNLIVA

SEQ ID NO: 41 - protein, 28 aa, Artificial Sequence
  Core polypeptide
IRDTNKAVQSVQSSIGNLIVAIKSVQDY

SEQ ID NO: 42 - protein, 28 aa, Artificial Sequence
  Core polypeptide
AVQSVQSSIGNLIVAIKSVQDYVNKEIV

SEQ ID NO: 43 - protein, 50 aa, Artificial Sequence
  Core polypeptide
QARQLLSGIVQQQNNLLRAIEAQQHLLQLTVWGIKQLARILAVERYLKDQ

SEQ ID NO: 44 - protein, 28 aa, Artificial Sequence
  Core polypeptide
QARQLLSGIVQQQNNLLRAIEAQQHLLQ

SEQ ID NO: 45 - protein, 48 aa, Artificial Sequence
  Core polypeptide
MTWMEMDREINNYTSLIGSLIEESQNQQEKNEQELLELDKWASLWNWF

SEQ ID NO: 46 - protein, 35 aa, Artificial Sequence
  Core polypeptide
WMEWDREINNYTSLIGSLIEESQNQQEKNEQELLE

SEQ ID NO: 47 - protein, 28 aa, Artificial Sequence
  Core polypeptide
INNYTSLIGSLIEESQNQQEKNEQELLE

SEQ ID NO: 48 - protein, 35 aa, Artificial Sequence
  Core polypeptide
INNYTSLIGSLIEESQNQQEKNEQELLELDKWASL

SEQ ID NO: 49 - protein, 33 aa, Artificial Sequence
  Core polypeptide
EWDREINNYTSLIGSLIEESQNQQEKNEQEGGC

SEQ ID NO: 50 - protein, 28 aa, Artificial Sequence
  Core polypeptide
QSRTLLAGIVQQQQQLLDVVKRQQELLR

SEQ ID NO: 51 - protein, 44 aa, Artificial Sequence
  Core polypeptide
NNDTWQEWERKVDFLEENITALLEEAQIQQEKNMYELQKLNSWD

SEQ ID NO: 52 - protein, 28 aa, Artificial Sequence
  Core polypeptide
WQEWERKVDFLEENITALLEEAQIQQEK

SEQ ID NO: 53 - protein, 28 aa, Artificial Sequence
  Core polypeptide
VDFLEENITALLEEAQIQQEKNMYELQK

SEQ ID NO: 54 - protein, 28 aa, Artificial Sequence
  Core polypeptide
ITALLEEAQIQQEKNMYELQKLNSWDVF

SEQ ID NO: 55 - protein, 36 aa, Artificial Sequence
  Core polypeptide
SSESFTLLEQWNNWKLQLAEQWLEQINEKHYLEDIS

SEQ ID NO: 56 - protein, 10 aa, Artificial Sequence
  Core polypeptide
DKWASLWNWF

SEQ ID NO: 57 - protein, 18 aa, Artificial Sequence
  Core polypeptide
NEQELLELDKWASLWNWF

SEQ ID NO: 58 - protein, 20 aa, Artificial Sequence
  Core polypeptide
EKNEQELLELDKWASLWNWF

SEQ ID NO: 59 - protein, 23 aa, Artificial Sequence
  Core polypeptide
NQQEKNEQELLELDKWASLWNWF

SEQ ID NO: 60 - protein, 26 aa, Artificial Sequence
  Core polypeptide
ESQNQQEKNEQELLELDKWASLWNWF

SEQ ID NO: 61 - protein, 33 aa, Artificial Sequence
  Core polypeptide
LIHSLIEESQNQQEKNEQELLELDKWASLWNWF

SEQ ID NO: 62 - protein, 28 aa, Artificial Sequence
  Core polypeptide
NDQKKLMSNNVQIVRQQSYSIMSIIKEE

SEQ ID NO: 63 - protein, 28 aa, Artificial Sequence
  Core polypeptide
DEFDASISQVNEKINQSLAFIRKSDELL

SEQ ID NO: 64 - protein, 27 aa, Artificial Sequence
  Core polypeptide
VSKGYSALRTGWYTSVITIELSNIKEN

SEQ ID NO: 65 - protein, 27 aa, Artificial Sequence
  Core polypeptide
VVSLSNGVSVLTSKVLDLKNYIDKQLL

SEQ ID NO: 66 - protein, 28 aa, Artificial Sequence
  Core polypeptide
VNKIKSALLSTNKAVVSLSNGVSVLTSK

SEQ ID NO: 67 - protein, 35 aa, Artificial Sequence
  Core polypeptide
PIINFYDPLVFPSDEFDASISQVNEKINQSLAFIR

SEQ ID NO: 68 - protein, 28 aa, Artificial Sequence
  Core polypeptide
NLVYAQLQFTYDTLRGYINRALAQIAEA

SEQ ID NO: 69 - protein, 31 aa, Artificial Sequence
  Core polypeptide
LNQVDLTETLERYQQRLNTYALVSKDASYRS

SEQ ID NO: 70 - protein, 27 aa, Artificial Sequence
  Core polypeptide
ELLVLKKAQLNRHSYLKDSDFLDAALD

SEQ ID NO: 71 - protein, 27 aa, Artificial Sequence
  Core polypeptide
LAEAGEESVTEDTEREDTEEEREDEEE

SEQ ID NO: 72 - protein, 35 aa, Artificial Sequence
  Core polypeptide
ALLAEAGEESVTEDTEREDTEEEREDEEEENEART

SEQ ID NO: 73 - protein, 35 aa, Artificial Sequence
  Core polypeptide
ETERSVDLVAALLAEAGEESVTEDTEREDTEEERE

SEQ ID NO: 74 - protein, 28 aa, Artificial Sequence
  Core polypeptide
EESVTEDTEREDTEEEREDEEEENEART

SEQ ID NO: 75 - protein, 28 aa, Artificial Sequence
  Core polypeptide
VDLVAALLAEAGEESVTEDTEREDTEEE

SEQ ID NO: 76 - protein, 25 aa, Artificial Sequence
  Core polypeptide
NSETERSVDLVAALLAEAGEESVTE

SEQ ID NO: 77 - protein, 28 aa, Artificial Sequence
  Core polypeptide
DISYAQLQFTYDVLKDYINDALRNIMDA

SEQ ID NO: 78 - protein, 30 aa, Artificial Sequence
  Core polypeptide
SNVFSKDEIMREYNSQKQHIRTLSAKVNDN

SEQ ID NO: 79 - protein, 35 aa, Artificial Sequence
  Core polypeptide
IDISIELNKAKSDLEEAKEWIKKANQKLDSIGNWH

SEQ ID NO: 80 - protein, 35 aa, Artificial Sequence
  Core polypeptide
IDISIELNKAKSDLEESKEWIKKANQKLDSIGNWH

SEQ ID NO: 81 - protein, 39 aa, Artificial Sequence
  Core polypeptide
YESTQKAFDGITNKVNSVIEKTNTQFEAVGKEFGNLEKR

SEQ ID NO: 82 - protein, 28 aa, Artificial Sequence
  Core polypeptide
DEYDASISQVNEKINQSLAFIRKSDELL

SEQ ID NO: 83 - protein, 38 aa, Artificial Sequence
  Core polypeptide
VLHQLNIQLKQYLETQERLLAGNRIAARQLLQIWKDVA

SEQ ID NO: 84 - protein, 38 aa, Artificial Sequence
  Core polypeptide
LWHEQLLNTAQRAGLQLQLINQALAVREKVLIRYDIQK

SEQ ID NO: 85 - protein, 35 aa, Artificial Sequence
  Core polypeptide
LLDNFESTWEQSKELWEQQEISIQNLHKSALQEYW

SEQ ID NO: 86 - protein, 36 aa, Artificial Sequence
  Core polypeptide
LSNLLQISNNSDEWLEALEIEHEKWKLTQWQSYEQF

SEQ ID NO: 87 - protein, 36 aa, Artificial Sequence
  Core polypeptide
KLEALEGKLEALEGKLEALEGKLEALEGKLEALEGK

SEQ ID NO: 88 - protein, 29 aa, Artificial Sequence
  Core polypeptide
ELRALRGELRALRGELRALRGELRALRGK

SEQ ID NO: 89 - protein, 36 aa, Artificial Sequence
  Core polypeptide
ELKAKELEGEGLAEGEEALKGLLEKAAKLEGLELLK

SEQ ID NO: 90 - protein, 33 aa, Artificial Sequence
  Core polypeptide
MEWDREINNYTSLIHSLIEESQNQQEKNEQELL

SEQ ID NO: 91 - protein, 36 aa, Artificial Sequence
  Core polypeptide
YTSLIHSLIEESQNQQEKNEQELLELDKWASLWNAF

SEQ ID NO: 92 - protein, 36 aa, Artificial Sequence
  Core polypeptide
YTSLIHSLIEESQNQQEKNEQELLELDKWASLANWF

SEQ ID NO: 93 - protein, 36 aa, Artificial Sequence
  Core polypeptide
YTSLIHSLIEESQNQQEKNQQELLELDKWASLWNWF

SEQ ID NO: 94 - protein, 36 aa, Artificial Sequence
  Core polypeptide
YTSLIHSLIEESQNQQEKNEQELLQLDKWASLWNWF

SEQ ID NO: 95 - protein, 36 aa, Artificial Sequence
  Core polypeptide
YTSLIHSLIEESQNQQEKNQQELLQLDKWASLWNWF

SEQ ID NO: 96 - protein, 33 aa, Artificial Sequence
  Core polypeptide
RMKQLEDKVEELLSKNYHLENEVARLKKLVGER

SEQ ID NO: 97 - protein, 28 aa, Artificial Sequence
  Core polypeptide
QQLLQLTVWGIKQLQARILAVERYLKNQ

SEQ ID NO: 98 - protein, 18 aa, Artificial Sequence
  Core polypeptide
NEQELLELDKWASLWNWF

SEQ ID NO: 99 - protein, 36 aa, Artificial Sequence
  Core polypeptide
YTSLIQSLIEESQNQQEKNEQELLELDKWASLWNWF

SEQ ID NO: 100 - protein, 35 aa, Artificial Sequence
  Core polypeptide
IINFYDPLVFPSDEFDASISQVNEKINQSLAFIRK

SEQ ID NO: 101 - protein, 35 aa, Artificial Sequence
  Core polypeptide
INFYDPLVFPSDEFDASISQVNEKINQSLAFIRKS

SEQ ID NO: 102 - protein, 35 aa, Artificial Sequence
  Core polypeptide
NFYDPLVFPSDEFDASISQVNEKINQSLAFIRKSD

SEQ ID NO: 103 - protein, 35 aa, Artificial Sequence
  Core polypeptide
FYDPLVFPSDEFDASISQVNEKINQSLAFIRKSDE

SEQ ID NO: 104 - protein, 35 aa, Artificial Sequence
  Core polypeptide
YDPLVFPSDEFDASISQVNEKINQSLAFIRKSDEL

SEQ ID NO: 105 - protein, 35 aa, Artificial Sequence
  Core polypeptide
DPLVFPSDEFDASISQVNEKINQSLAFIRKSDELL

SEQ ID NO: 106 - protein, 35 aa, Artificial Sequence
  Core polypeptide
PLVFPSDEFDASISQVNEKINQSLAFIRKSDELLH

SEQ ID NO: 107 - protein, 35 aa, Artificial Sequence
  Core polypeptide
LVFPSDEFDASISQVNEKINQSLAFIRKSDELLHN

SEQ ID NO: 108 - protein, 35 aa, Artificial Sequence
  Core polypeptide
VFPSDEFDASISQVNEKINQSLAFIRKSDELLHNV

SEQ ID NO: 109 - protein, 35 aa, Artificial Sequence
  Core polypeptide
FPSDEFDASISQVNEKINQSLAFIRKSDELLHNVN

SEQ ID NO: 110 - protein, 35 aa, Artificial Sequence
  Core polypeptide
PSDEFDASISQVNEKINQSLAFIRKSDELLHNVNA

SEQ ID NO: 111 - protein, 35 aa, Artificial Sequence
  Core polypeptide
SDEFDASISQVNEKINQSLAFIRKSDELLHNVNAG

SEQ ID NO: 112 - protein, 35 aa, Artificial Sequence
  Core polypeptide
DEFDASISQVNEKINQSLAFIRKSDELLHNVNAGK

SEQ ID NO: 113 - protein, 35 aa, Artificial Sequence
  Core polypeptide
EFDASISQVNEKINQSLAFIRKSDELLHNVNAGKS

SEQ ID NO: 114 - protein, 35 aa, Artificial Sequence
  Core polypeptide
FDASISQVNEKINQSLAFIRKSDELLHNVNAGKST

SEQ ID NO: 115 - protein, 35 aa, Artificial Sequence
  Core polypeptide
DASISQVNEKINQSLAFIRKSDELLHNVNAGKSTT

SEQ ID NO: 116 - protein, 35 aa, Artificial Sequence
  Core polypeptide
ASGVAVSKVLHLEGEVNKIKSALLSTNKAVVSLSN

SEQ ID NO: 117 - protein, 35 aa, Artificial Sequence; identical to SEQ ID NO: 24
  Core polypeptide

SEQ ID NO: 118 - protein, 35 aa, Artificial Sequence
  Core polypeptide
GVAVSKVLHLEGEVNKIKSALLSTNKAVVSLSNGV

SEQ ID NO: 119 - protein, 35 aa, Artificial Sequence
  Core polypeptide
VAVSKVLHLEGEVNKIKSALLSTNKAVVSLSNGVS

SEQ ID NO: 120 - protein, 35 aa, Artificial Sequence
  Core polypeptide
AVSKVLHLEGEVNKIKSALLSTNKAVVSLSNGVSV

SEQ ID NO: 121 - protein, 35 aa, Artificial Sequence
  Core polypeptide
VSKVLHLEGEVNKIKSALLSTNKAVVSLSNGVSVL

SEQ ID NO: 122 - protein, 35 aa, Artificial Sequence
  Core polypeptide
SKVLHLEGEVNKIKSALLSTNKAVVSLSNGVSVLT

SEQ ID NO: 123 - protein, 35 aa, Artificial Sequence
  Core polypeptide
KVLHLEGEVNKIKSALLSTNKAVVSLSNGVSVLTS

SEQ ID NO: 124 - protein, 35 aa, Artificial Sequence
  Core polypeptide
VLHLEGEVNKIKSALLSTNKAVVSLSNGVSVLTSK

SEQ ID NO: 125 - protein, 35 aa, Artificial Sequence
  Core polypeptide
LHLEGEVNKIKSALLSTNKAVVSLSNGVSVLTSKV

SEQ ID NO: 126 - protein, 35 aa, Artificial Sequence
  Core polypeptide
HLEGEVNKIKSALLSTNKAVVSLSNGVSVLTSKVL

SEQ ID NO: 127 - protein, 35 aa, Artificial Sequence
  Core polypeptide
LEGEVNKIKSALLSTNKAVVSLSNGVSVLTSKVLD

SEQ ID NO: 128 - protein, 35 aa, Artificial Sequence
  Core polypeptide
EGEVNKIKSALLSTNKAVVSLSNGVSVLTSKVLDL

SEQ ID NO: 129 - protein, 35 aa, Artificial Sequence
  Core polypeptide
GEVNKIKSALLSTNKAVVSLSNGVSVLTSKVLDLK

SEQ ID NO: 130 - protein, 35 aa, Artificial Sequence
  Core polypeptide
EVNKIKSALLSTNKAVVSLSNGVSVLTSKVLDLKN

SEQ ID NO: 131 - protein, 35 aa, Artificial Sequence
  Core polypeptide
VNKIKSALLSTNKAVVSLSNGVSVLTSKVLDLKNY

SEQ ID NO: 132 - protein, 35 aa, Artificial Sequence
  Core polypeptide
NKIKSALLSTNKAVVSLSNGVSVLTSKVLDLKNYI

SEQ ID NO: 133 - protein, 35 aa, Artificial Sequence
  Core polypeptide
KIKSALLSTNKAVVSLSNGVSVLTSKVLDLKNYID

SEQ ID NO: 134 - protein, 35 aa, Artificial Sequence
  Core polypeptide
IKSALLSTNKAVVSLSNGVSVLTSKVLDLKNYIDK

SEQ ID NO: 135 - protein, 35 aa, Artificial Sequence
  Core polypeptide
KSALLSTNKAVVSLSNGVSVLTSKVLDLKNYIDKQ

SEQ ID NO: 136 - protein, 35 aa, Artificial Sequence
  Core polypeptide
SALLSTNKAVVSLSNGVSVLTSKVLDLKNYIDKQL

SEQ ID NO: 137 - protein, 35 aa, Artificial Sequence
  Core polypeptide
ALLSTNKAVVSLSNGVSVLTSKVLDLKNYIDKQLL

SEQ ID NO: 138 - protein, 35 aa, Artificial Sequence
  Core polypeptide
YTSVITIELSNIKENKCNGTDAKVKLIKQELDKYK

SEQ ID NO: 139 - protein, 35 aa, Artificial Sequence
  Core polypeptide
TSVITIELSNIKENKCNGTDAKVKLIKQELDKYKN

SEQ ID NO: 140 - protein, 35 aa, Artificial Sequence
  Core polypeptide
SVITIELSNIKENKCNGTDAKVKLIKQELDKYKNA

SEQ ID NO: 141 - protein, 35 aa, Artificial Sequence
  Core polypeptide
VITIELSNIKENKCNGTDAKVKLIKQELDKYKNAV

SEQ ID NO: 142 - protein, 35 aa, Artificial Sequence
  Core polypeptide
ITIELSNIKENKCNGTDAKVKLIKQELDKYKNAVT

SEQ ID NO: 143 - protein, 35 aa, Artificial Sequence
  Core polypeptide
TIELSNIKENKCNGTDAKVKLIKQELDKYKNAVTE

SEQ ID NO: 144 - protein, 35 aa, Artificial Sequence
  Core polypeptide
IELSNIKENKCNGTDAKVKLIKQELDKYKNAVTEL

SEQ ID NO: 145 - protein, 35 aa, Artificial Sequence
  Core polypeptide
ELSNIKENKCNGTDAKVKLIKQELDKYKNAVTELQ

SEQ ID NO: 146 - protein, 35 aa, Artificial Sequence
  Core polypeptide
LSNIKENKCNGTDAKVKLIKQELDKYKNAVTELQL

SEQ ID NO: 147 - protein, 35 aa, Artificial Sequence; identical to SEQ ID NO: 22
  Core polypeptide

SEQ ID NO: 148 - protein, 35 aa, Artificial Sequence
  Core polypeptide
NIKENKCNGTDAKVKLIKQELDKYKNAVTELQLLM

SEQ ID NO: 149 - protein, 35 aa, Artificial Sequence
  Core polypeptide
IKENKCNGTDAKVKLIKQELDKYKNAVTELQLLMQ

SEQ ID NO: 150 - protein, 35 aa, Artificial Sequence
  Core polypeptide
KENKCNGTDAKVKLIKQELDKYKNAVTELQLLMQS

SEQ ID NO: 151 - protein, 35 aa, Artificial Sequence
  Core polypeptide
ENKCNGTDAKVKLIKQELDKYKNAVTELQLLMQST

SEQ ID NO: 152 - protein, 36 aa, Artificial Sequence
  Core polypeptide
LLDNFESTWEQSKELWELQEISIQNLHKSALQEYWN

SEQ ID NO: 153 - protein, 35 aa, Artificial Sequence
  Core polypeptide
ALGVATSAQITAAVALVEAKQARSDIEKLKEAIRD

SEQ ID NO: 154 - protein, 35 aa, Artificial Sequence
  Core polypeptide
LGVATSAQITAAVALVEAKQARSDIEKLKEAIRDT

SEQ ID NO: 155 - protein, 35 aa, Artificial Sequence
  Core polypeptide
GVATSAQITAAVALVEAKQARSDIEKLKEAIRDTN

SEQ ID NO: 156 - protein, 35 aa, Artificial Sequence
  Core polypeptide
VATSAQITAAVALVEAKQARSDIEKLKEAIRDTNK

SEQ ID NO: 157 - protein, 35 aa, Artificial Sequence
  Core polypeptide
ATSAQITAAVALVEAKQARSDIEKLKEAIRDTNKA

SEQ ID NO: 158 - protein, 35 aa, Artificial Sequence
  Core polypeptide
TSAQITAAVALVEAKQARSDIEKLKEAIRDTNKAV

SEQ ID NO: 159 - protein, 35 aa, Artificial Sequence
  Core polypeptide
SAQITAAVALVEAKQARSDIEKLKEAIRDTNKAVQ

SEQ ID NO: 160 - protein, 35 aa, Artificial Sequence
  Core polypeptide
AQITAAVALVEAKQARSDIEKLKEAIRDTNKAVQS

SEQ ID NO: 161 - protein, 35 aa, Artificial Sequence
  Core polypeptide
QITAAVALVEAKQARSDIEKLKEAIRDTNKAVQSV

SEQ ID NO: 162 - protein, 35 aa, Artificial Sequence
  Core polypeptide
ITAAVALVEAKQARSDIEKLKEAIRDTNKAVQSVQ

SEQ ID NO: 163 - protein, 35 aa, Artificial Sequence
  Core polypeptide
TAAVALVEAKQARSDIEKLKEAIRDTNKAVQSVQS

SEQ ID NO: 164 - protein, 35 aa, Artificial Sequence; identical to SEQ ID NO: 34
  Core polypeptide

SEQ ID NO: 165 - protein, 35 aa, Artificial Sequence
  Core polypeptide
AVALVEAKQARSDIEKLKEAIRDTNKAVQSVQSSI

SEQ ID NO: 166 - protein, 35 aa, Artificial Sequence
  Core polypeptide
VALVEAKQARSDIEKLKEAIRDTNKAVQSVQSSIG

SEQ ID NO: 167 - protein, 35 aa, Artificial Sequence
  Core polypeptide
ALVEAKQARSDIEKLKEAIRDTNKAVQSVQSSIGN

SEQ ID NO: 168 - protein, 35 aa, Artificial Sequence
  Core polypeptide
LVEAKQARSDIEKLKEAIRDTNKAVQSVQSSIGNL

SEQ ID NO: 169 - protein, 35 aa, Artificial Sequence
  Core polypeptide
VEAKQARSDIEKLKEAIRDTNKAVQSVQSSIGNLI

SEQ ID NO: 170 - protein, 35 aa, Artificial Sequence
  Core polypeptide
EAKQARSDIEKLKEAIRDTNKAVQSVQSSIGNLIV

SEQ ID NO: 171 - protein, 35 aa, Artificial Sequence
  Core polypeptide
KQARSDIEKLKEAIRDTNKAVQSVQSSIGNLIVAI

SEQ ID NO: 172 - protein, 34 aa, Artificial Sequence
  Core polypeptide
QARSDEKLKEAIRDTNKAVQSVQSSIGNLIVAIK

SEQ ID NO: 173 - protein, 35 aa, Artificial Sequence
  Core polypeptide
QARSDIEKLKEAIRDTNKAVQSVQSSIGNLIVAIK

SEQ ID NO: 174 - protein, 35 aa, Artificial Sequence
  Core polypeptide
ARSDIEKLKEAIRDTNKAVQSVQSSIGNLIVAIKS

SEQ ID NO: 175 - protein, 35 aa, Artificial Sequence
  Core polypeptide
RSDIEKLKEAIRDTNKAVQSVQSSIGNLIVAIKSV

SEQ ID NO: 176 - protein, 35 aa, Artificial Sequence
  Core polypeptide
SDIEKLKEAIRDTNKAVQSVQSSIGNLIVAIKSVQ

SEQ ID NO: 177 - protein, 35 aa, Artificial Sequence
  Core polypeptide
DIEKLKEAIRDTNKAVQSVQSSIGNLIVAIKSVQD

SEQ ID NO: 178 - protein, 35 aa, Artificial Sequence
  Core polypeptide
IEKLKEAIRDTNKAVQSVQSSIGNLIVAIKSVQDY

SEQ ID NO: 179 - protein, 35 aa, Artificial Sequence
  Core polypeptide
EKLKEAIRDTNKAVQSVQSSIGNLIVAIKSVQDYV

SEQ ID NO: 180 - protein, 35 aa, Artificial Sequence
  Core polypeptide
KLKEAIRDTNKAVQSVQSSIGNLIVAIKSVQDYVN

SEQ ID NO: 181 - protein, 35 aa, Artificial Sequence
  Core polypeptide
LKEAIRDTNKAVQSVQSSIGNLIVAIKSVQDYVNK

SEQ ID NO: 182 - protein, 35 aa, Artificial Sequence
  Core polypeptide
KEAIRDTNKAVQSVQSSIGNLIVAIKSVQDYVNKE

SEQ ID NO: 183 - protein, 35 aa, Artificial Sequence
  Core polypeptide
EAIRDTNKAVQSVQSSIGNLIVAIKSVQDYVNKEI

SEQ ID NO: 184 - protein, 35 aa, Artificial Sequence
  Core polypeptide
AIRDTNKAVQSVQSSIGNLIVAIKSVQDYVNKEIV

SEQ ID NO: 185 - protein, 34 aa, Artificial Sequence
  Core polypeptide
IRDTNKAVQSVQSSIGNLIVAIKSVQDYVNKEIV

SEQ ID NO: 186 - protein, 35 aa, Artificial Sequence
  Core polypeptide
YTPNDITLNNSVALDPIDISIELNKAKSDLEESKE

SEQ ID NO: 187 - protein, 35 aa, Artificial Sequence
  Core polypeptide
TPNDITLNNSVALDPIDISIELNKAKSDLEESKEW

SEQ ID NO: 188 - protein, 35 aa, Artificial Sequence
  Core polypeptide
PNDITLNNSVALDPIDISIELNKAKSDLEESKEWI

SEQ ID NO: 189 - protein, 35 aa, Artificial Sequence
  Core polypeptide
NDITLNNSVALDPIDISIELNKAKSDLEESKEWIR

SEQ ID NO: 190 - protein, 35 aa, Artificial Sequence
  Core polypeptide
DITLNNSVALDPIDISIELNKAKSDLEESKEWIRR

SEQ ID NO: 191 - protein, 35 aa, Artificial Sequence
  Core polypeptide
ITLNNSVALDPIDISIELNKAKSDLEESKEWIRRS

SEQ ID NO: 192 - protein, 35 aa, Artificial Sequence
  Core polypeptide
TLNNSVALDPIDISIELNKAKSDLEESKEWIRRSN

SEQ ID NO: 193 - protein, 35 aa, Artificial Sequence
  Core polypeptide
LNNSVALDPIDISIELNKAKSDLEESKEWIRRSNQ

SEQ ID NO: 194 - protein, 35 aa, Artificial Sequence
  Core polypeptide
NNSVALDPIDISIELNKAKSDLEESKEWIRRSNQK

SEQ ID NO: 195 - protein, 35 aa, Artificial Sequence
  Core polypeptide
NSVALDPIDISIELNKAKSDLEESKEWIRRSNQKL

SEQ ID NO: 196 - protein, 35 aa, Artificial Sequence
  Core polypeptide
SVALDPIDISIELNKAKSDLEESKEWIRRSNQKLD

SEQ ID NO: 197 - protein, 35 aa, Artificial Sequence
  Core polypeptide
VALDPIDISIELNKAKSDLEESKEWIRRSNQKLDS

SEQ ID NO: 198 - protein, 35 aa, Artificial Sequence
  Core polypeptide
ALDPIDISIELNKAKSDLEESKEWIRRSNQKLDSI

SEQ ID NO: 199 - protein, 35 aa, Artificial Sequence
  Core polypeptide
LDPIDISIELNKAKSDLEESKEWIRRSNQKLDSIG

SEQ ID NO: 200 - protein, 35 aa, Artificial Sequence
  Core polypeptide
DPIDISIELNKAKSDLEESKEWIRRSNQKLDSIGN

SEQ ID NO: 201 - protein, 35 aa, Artificial Sequence
  Core polypeptide
PIDISIELNKAKSDLEESKEWIRRSNQKLDSIGNW

SEQ ID NO: 202 - protein, 35 aa, Artificial Sequence
  Core polypeptide
IDISIELNKAKSDLEESKEWIRRSNQKLDSIGNWH

SEQ ID NO: 203 - protein, 35 aa, Artificial Sequence
  Core polypeptide
DISIELNKAKSDLEESKEWIRRSNQKLDSIGNWHQ

SEQ ID NO: 204 - protein, 35 aa, Artificial Sequence
  Core polypeptide
ISIELNKAKSDLEESKEWIRRSNQKLDSIGNWHQS

SEQ ID NO: 205 - protein, 35 aa, Artificial Sequence
  Core polypeptide
SIELNKAKSDLEESKEWIRRSNQKLDSIGNWHQSS

SEQ ID NO: 206 - protein, 35 aa, Artificial Sequence
  Core polypeptide
IELNKAKSDLEESKEWIRRSNQKLDSIGNWHQSST

SEQ ID NO: 207 - protein, 35 aa, Artificial Sequence
  Core polypeptide
ELNKAKSDLEESKEWIRRSNQKLDSIGNWHQSSTT

SEQ ID NO: 208 - protein, 36 aa, Artificial Sequence
  Core polypeptide
ELRALRGELRALRGELRALRGELRALRGELRALRGK

SEQ ID NO: 209 - protein, 36 aa, Artificial Sequence
  Core polypeptide
YTSLIHSLIEESQNQQQKNEQELLELDKWASLWNWF

SEQ ID NO: 210 - protein, 36 aa, Artificial Sequence
  Core polypeptide
YTSLIHSLIEESQNQQEKNEQELLELNKWASLWNWF

SEQ ID NO: 211 - protein, 36 aa, Artificial Sequence
  Core polypeptide
YTSLIHSLIEQSQNQQEKNEQELLELDKWASLWNWF

SEQ ID NO: 212 - protein, 36 aa, Artificial Sequence
  Core polypeptide
YTSLIHSLIQESQNQQEKNEQELLELDKWASLWNWF

SEQ ID NO: 213 - protein, 36 aa, Artificial Sequence
  Core polypeptide
YTSLIHSLIQQSQNQQQKNQQQLLQLNKWASLWNWF

SEQ ID NO: 214 - protein, 17 aa, Artificial Sequence
  Core polypeptide
EQELLELDKWASLWNWF

SEQ ID NO: 215 - protein, 16 aa, Artificial Sequence
  Core polypeptide
QELLELDKWASLWNWF

SEQ ID NO: 216 - protein, 15 aa, Artificial Sequence
  Core polypeptide
ELLELDKWASLWNWF

SEQ ID NO: 217 - protein, 14 aa, Artificial Sequence
  Core polypeptide
LLELDKWASLWNWF

SEQ ID NO: 218 - protein, 13 aa, Artificial Sequence
  Core polypeptide
LELDKWASLWNWF

SEQ ID NO: 219 - protein, 12 aa, Artificial Sequence
  Core polypeptide
ELDKWASLWNWF

SEQ ID NO: 220 - protein, 11 aa, Artificial Sequence
  Core polypeptide
LDKWASLWNWF

SEQ ID NO: 221 - protein, 10 aa, Artificial Sequence
  Core polypeptide
DKWASLWNWF

SEQ ID NO: 222 - protein, 9 aa, Artificial Sequence
  Core polypeptide
KWASLWNWF

SEQ ID NO: 223 - protein, 8 aa, Artificial Sequence
  Core polypeptide
WASLWNWF

SEQ ID NO: 224 - protein, 7 aa, Artificial Sequence
  Core polypeptide
ASLWNWF

SEQ ID NO: 225 - protein, 18 aa, Artificial Sequence
  Core polypeptide
YTSLIHSLIEESQNQQEK

SEQ ID NO: 226 - protein, 36 aa, Artificial Sequence
  Core polypeptide
YTSLIHSLIEESQNQQEKNEQELLELDKWASLANAA

SEQ ID NO: 227 - protein, 36 aa, Artificial Sequence
  Core polypeptide
YTSLIHSLIEESQNQQEKNEQQLLELDKWASLWNWF

SEQ ID NO: 228 - protein, 36 aa, Artificial Sequence
  Core polypeptide
YTSLIQSLIEESQNQQEKNQQELLELDKWASLWNWF

SEQ ID NO: 229 - protein, 14 aa, Artificial Sequence
  Core polypeptide
CLELDKWASLWNWF

SEQ ID NO: 230 - protein, 13 aa, Artificial Sequence
  Core polypeptide
LELDKFASLFNFF

SEQ ID NO: 231 - protein, 28 aa, Artificial Sequence
  Core polypeptide
EAAAREAAAREAAARLELDKWASLWNWF

SEQ ID NO: 232 - protein, 28 aa, Artificial Sequence
  Core polypeptide
RMKQLEDKVEELLSKLELDKWASLWNWF

SEQ ID NO: 233 - protein, 35 aa, Artificial Sequence
  Core polypeptide
PSLRDPISAEISIQALSYALGGDINKVLEKLGYSG

SEQ ID NO: 234 - protein, 35 aa, Artificial Sequence
  Core polypeptide
SLRDPISAEISIQALSYALGGDINKVLEKLGYSGG

SEQ ID NO: 235 - protein, 35 aa, Artificial Sequence
  Core polypeptide
LRDPISAEISIQALSYALGGDINKVLEKLGYSGGD

SEQ ID NO: 236 - protein, 35 aa, Artificial Sequence
  Core polypeptide
RDPISAEISIQALSYALGGDINKVLEKLGYSGGDL

SEQ ID NO: 237 - protein, 35 aa, Artificial Sequence
  Core polypeptide
DPISAEISIQALSYALGGDINKVLEKLGYSGGDLL

SEQ ID NO: 238 - protein, 35 aa, Artificial Sequence
  Core polypeptide
PISAEISIQALSYALGGDINKVLEKLGYSGGDLLG

SEQ ID NO: 239 - protein, 35 aa, Artificial Sequence
  Core polypeptide
ISAEISIQALSYALGGDINKVLEKLGYSGGDLLGI

SEQ ID NO: 240 - protein, 35 aa, Artificial Sequence
  Core polypeptide
SAEISIQALSYALGGDINKVLEKLGYSGGDLLGIL

SEQ ID NO: 241 - protein, 35 aa, Artificial Sequence
  Core polypeptide
AEISIQALSYALGGDINKVLEKLGYSGGDLLGILE

SEQ ID NO: 242 - protein, 35 aa, Artificial Sequence
  Core polypeptide
EISIQALSYALGGDINKVLEKLGYSGGDLLGILES

SEQ ID NO: 243 - protein, 35 aa, Artificial Sequence
  Core polypeptide
ISIQALSYALGGDINKVLEKLGYSGGDLLGILESR

SEQ ID NO: 244 - protein, 35 aa, Artificial Sequence
  Core polypeptide
SIQALSYALGGDINKVLEKLGYSGGDLLGILESRG

SEQ ID NO: 245 - protein, 35 aa, Artificial Sequence
  Core polypeptide
IQALSYALGGDINKVLEKLGYSGGDLLGILESRGI

SEQ ID NO: 246 - protein, 35 aa, Artificial Sequence
  Core polypeptide
QALSYALGGDINKVLEKLGYSGGDLLGILESRGIK

SEQ ID NO: 247 - protein, 35 aa, Artificial Sequence
  Core polypeptide
ALSYALGGDINKVLEKLGYSGGDLLGILESRGIKA

SEQ ID NO: 248 - protein, 35 aa, Artificial Sequence
  Core polypeptide
LSYALGGDINKVLEKLGYSGGDLLGILESRGIKAR

SEQ ID NO: 249 - protein, 35 aa, Artificial Sequence
  Core polypeptide
PDAVYLHRIDLGPPISLERLDVGTNLGNAIAKLED

SEQ ID NO: 250 - protein, 35 aa, Artificial Sequence
  Core polypeptide
DAVYLHRIDLGPPISLERLDVGTNLGNAIAKLEDA

SEQ ID NO: 251 - protein, 35 aa, Artificial Sequence
  Core polypeptide
AVYLHRIDLGPPISLERLDVGTNLGNAIAKLEDAK

SEQ ID NO: 252 - protein, 35 aa, Artificial Sequence
  Core polypeptide
VYLHRIDLGPPISLERLDVGTNLGNAIAKLEDAKE

SEQ ID NO: 253 - protein, 35 aa, Artificial Sequence
  Core polypeptide
YLHRIDLGPPISLERLDVGTNLGNAIAKLEDAKEL

SEQ ID NO: 254 - protein, 35 aa, Artificial Sequence
  Core polypeptide
LHRIDLGPPISLERLDVGTNLGNAIAKLEDAKELL

SEQ ID NO: 255 - protein, 35 aa, Artificial Sequence
  Core polypeptide
HRIDLGPPISLERLDVGTNLGNAIAKLEDAKELLE

SEQ ID NO: 256 - protein, 35 aa, Artificial Sequence
  Core polypeptide
RIDLGPPISLERLDVGTNLGNAIAKLEDAKELLES

SEQ ID NO: 257 - protein, 35 aa, Artificial Sequence
  Core polypeptide
IDLGPPISLERLDVGTNLGNAIAKLEDAKELLESS

SEQ ID NO: 258 - protein, 35 aa, Artificial Sequence
  Core polypeptide
DLGPPISLERLDVGTNLGNAIAKLEDAKELLESSD

SEQ ID NO: 259 - protein, 35 aa, Artificial Sequence
  Core polypeptide
LGPPISLERLDVGTNLGNAIAKLEDAKELLESSDQ

SEQ ID NO: 260 - protein, 35 aa, Artificial Sequence
  Core polypeptide
GPPISLERLDVGTNLGNAIAKLEDAKELLESSDQI

SEQ ID NO: 261 - protein, 35 aa, Artificial Sequence
  Core polypeptide
PPISLERLDVGTNLGNAIAKLEDAKELLESSDQIL

SEQ ID NO: 262 - protein, 35 aa, Artificial Sequence
  Core polypeptide
PISLERLDVGTNLGNAIAKLEDAKELLESSDQILR

SEQ ID NO: 263 - protein, 34 aa, Artificial Sequence
  Core polypeptide
ISLERLDVGTNLGNAIAKLEDAKELLESSDQIRS

SEQ ID NO: 264 - protein, 35 aa, Artificial Sequence
  Core polypeptide
SLERLDVGTNLGNAIAKLEDAKELLESSDQILRSM

SEQ ID NO: 265 - protein, 35 aa, Artificial Sequence
  Core polypeptide
LERLDVGTNLGNAIAKLEDAKELLESSDQILRSMK

SEQ ID NO: 266 - protein, 13 aa, Artificial Sequence
  Core polypeptide
EWIRRSNQKLDSI

SEQ ID NO: 267 - protein, 13 aa, Artificial Sequence
  Core polypeptide
LELDKWASLANAF

SEQ ID NO: 268 - protein, 13 aa, Artificial Sequence
  Core polypeptide
LELDKWASLFNFF

SEQ ID NO: 269 - protein, 13 aa, Artificial Sequence
  Core polypeptide
LELDKWASLANWF

SEQ ID NO: 270 - protein, 13 aa, Artificial Sequence
  Core polypeptide
LELDKWASLWNAF

SEQ ID NO: 271 - protein, 35 aa, Artificial Sequence
  Core polypeptide
ELGNVNNSISNALDKLEESNSKLDKVNVKLTSTSA

SEQ ID NO: 272 - protein, 35 aa, Artificial Sequence
  Core polypeptide
TELGNVNNSISNALDKLEESNSKLDKVNVKLTSTS

SEQ ID NO: 273 - protein, 35 aa, Artificial Sequence
  Core polypeptide
STELGNVNNSISNALDKLEESNSKLDKVNVKLTST

SEQ ID NO: 274 - protein, 35 aa, Artificial Sequence
  Core polypeptide
ISTELGNVNNSISNALDKLEESNSKLDKVNVKLTS

SEQ ID NO: 275 - protein, 35 aa, Artificial Sequence
  Core polypeptide
DISTELGNVNNSISNALDKLEESNSKLDKVNVKLT

SEQ ID NO: 276 - protein, 35 aa, Artificial Sequence
  Core polypeptide
LDISTELGNVNNSISNALDKLEESNSKLDKVNVKL

SEQ ID NO: 277 - protein, 35 aa, Artificial Sequence
  Core polypeptide
NLDISTELGNVNNSISNALDKLEESNSKLDKVNVK

SEQ ID NO: 278 - protein, 35 aa, Artificial Sequence
  Core polypeptide
GNLDISTELGNVNNSISNALDKLEESNSKLDKVNV

SEQ ID NO: 279 - protein, 35 aa, Artificial Sequence
  Core polypeptide
TGNLDISTELGNVNNSISNALDKLEESNSKLDKVN

SEQ ID NO: 280 - protein, 35 aa, Artificial Sequence
  Core polypeptide
VTGNLDISTELGNVNNSISNALDKLEESNSKLDKV

SEQ ID NO: 281 - protein, 35 aa, Artificial Sequence
  Core polypeptide
IVTGNLDISTELGNVNNSISNALDKLEESNSKLDK

SEQ ID NO: 282 - protein, 35 aa, Artificial Sequence
  Core polypeptide
VIVTGNLDISTELGNVNNSISNALDKLEESNSKLD

SEQ ID NO: 283 - protein, 35 aa, Artificial Sequence
  Core polypeptide
QVIVTGNLDISTELGNVNNSISNALDKLEESNSKL

SEQ ID NO: 284 - protein, 35 aa, Artificial Sequence
  Core polypeptide
SQVIVTGNLDISTELGNVNNSISNALDKLEESNSK

SEQ ID NO: 285 - protein, 35 aa, Artificial Sequence
  Core polypeptide
DSQVIVTGNLDISTELGNVNNSISNALDKLEESNS

SEQ ID NO: 286 - protein, 35 aa, Artificial Sequence
  Core polypeptide
LDSQVIVTGNLDISTELGNVNNSISNALDKLEESN

SEQ ID NO: 287 - protein, 35 aa, Artificial Sequence
  Core polypeptide
ILDSQVIVTGNLDISTELGNVNNSISNALDKLEES

SEQ ID NO: 288 - protein, 35 aa, Artificial Sequence
  Core polypeptide
SILDSQVIVTGNLDISTELGNVNNSISNALDKLEE

SEQ ID NO: 289 - protein, 35 aa, Artificial Sequence
  Core polypeptide
ISILDSQVIVTGNLDISTELGNVNNSISNALDKLE

SEQ ID NO: 290 - protein, 35 aa, Artificial Sequence
  Core polypeptide
NISILDSQVIVTGNLDISTELGNVNNSISNALDKL

SEQ ID NO: 291 - protein, 35 aa, Artificial Sequence
  Core polypeptide
KNISILDSQVIVTGNLDISTELGNVNNSISNALDK

SEQ ID NO: 292 - protein, 35 aa, Artificial Sequence
  Core polypeptide
QKNISILDSQVIVTGNLDISTELGNVNNSISNALD

SEQ ID NO: 293 - protein, 35 aa, Artificial Sequence
  Core polypeptide
YQKNISILDSQVIVTGNLDISTELGNVNNSISNAL

SEQ ID NO: 294 - protein, 35 aa, Artificial Sequence
  Core polypeptide
TYQKNISILDSQVIVTGNLDISTELGNVNNSISNA

SEQ ID NO: 295 - protein, 35 aa, Artificial Sequence
  Core polypeptide
ATYQKNISILDSQVIVTGNLDISTELGNVNNSISN

SEQ ID NO: 296 - protein, 35 aa, Artificial Sequence
  Core polypeptide
DATYQKNISILDSQVIVTGNLDISTELGNVNNSIS

SEQ ID NO: 297 - protein, 35 aa, Artificial Sequence
  Core polypeptide
FDATYQKNISILDSQVIVTGNLDISTELGNVNNSI

SEQ ID NO: 298 - protein, 35 aa, Artificial Sequence
  Core polypeptide
EFDATYQKNISILDSQVIVTGNLDISTELGNVNNS

SEQ ID NO: 299 - protein, 35 aa, Artificial Sequence
  Core polypeptide
GEFDATYQKNISILDSQVIVTGNLDISTELGNVNN

SEQ ID NO: 300 - protein, 35 aa, Artificial Sequence
  Core polypeptide
SGEFDATYQKNISILDSQVIVTGNLDISTELGNVN

SEQ ID NO: 301 - protein, 35 aa, Artificial Sequence
  Core polypeptide
LSGEFDATYQKNISILDSQVIVTGNLDISTELGNV

SEQ ID NO: 302 - protein, 35 aa, Artificial Sequence
  Core polypeptide
RLSGEFDATYQKNISILDSQVIVTGNLDISTELGN

SEQ ID NO: 303 - protein, 35 aa, Artificial Sequence
  Core polypeptide
LRLSGEFDATYQKNISILDSQVIVTGNLDISTELG

SEQ ID NO: 304 - protein, 35 aa, Artificial Sequence
  Core polypeptide
TLRLSGEFDATYQKNISILDSQVIVTGNLDISTEL

SEQ ID NO: 305 - protein, 35 aa, Artificial Sequence
  Core polypeptide
ITLRLSGEFDATYQKNISILDSQVIVTGNLDISTE

SEQ ID NO: 306 - protein, 35 aa, Artificial Sequence
  Core polypeptide
GITLRLSGEFDATYQKNISILDSQVIVTGNLDIST

SEQ ID NO: 307 - protein, 35 aa, Artificial Sequence
  Core polypeptide
TATIEAVHEVTDGLSQLAVAVGKMQQFVNDQFNNT

SEQ ID NO: 308 - protein, 35 aa, Artificial Sequence
  Core polypeptide
ITATIEAVHEVTDGLSQLAVAVGKMQQFVNDQFNN

SEQ ID NO: 309 - protein, 35 aa, Artificial Sequence
  Core polypeptide
SITATIEAVHEVTDGLSQLAVAVGKMQQFVNDQFN

SEQ ID NO: 310 - protein, 35 aa, Artificial Sequence
  Core polypeptide
KESITATIEAVHEVTDGLSQLAVAVGKMQQFVNDQ

SEQ ID NO: 311 - protein, 35 aa, Artificial Sequence
  Core polypeptide
LKESITATIEAVHEVTDGLSQLAVAVGKMQQFVND

SEQ ID NO: 312 - protein, 35 aa, Artificial Sequence
  Core polypeptide
RLKESITATIEAVHEVTDGLSQLAVAVGKMQQFVN

SEQ ID NO: 313 - protein, 35 aa, Artificial Sequence
  Core polypeptide
LRLKESITATIEAVHEVTDGLSQLAVAVGKMQQFV

SEQ ID NO: 314 - protein, 35 aa, Artificial Sequence
  Core polypeptide
ILRLKESITATIEAVHEVTDGLSQLAVAVGKMQQF

SEQ ID NO: 315 - protein, 35 aa, Artificial Sequence
  Core polypeptide
NILRLKESITATIEAVHEVTDGLSQLAVAVGKMQQ

SEQ ID NO: 316 - protein, 35 aa, Artificial Sequence
  Core polypeptide
ANILRLKESITATIEAVHEVTDGLSQLAVAVGKMQ

SEQ ID NO: 317 - protein, 35 aa, Artificial Sequence
  Core polypeptide
AANILRLKESITATIEAVHEVTDGLSQLAVAVGKM

SEQ ID NO: 318 - protein, 35 aa, Artificial Sequence
  Core polypeptide
HKCDDECMNSVKNGTYDYPKYEEESKLNRNEIKGV

SEQ ID NO: 319 - protein, 35 aa, Artificial Sequence
  Core polypeptide
KCDDECMNSVKNGTYDYPKYEEESKLNRNEIKGVK

SEQ ID NO: 320 - protein, 35 aa, Artificial Sequence
  Core polypeptide
CDDECMNSVKNGTYDYPKYEEESKLNRNEIKGVKL

SEQ ID NO: 321 - protein, 35 aa, Artificial Sequence
  Core polypeptide
DDECMNSVKNGTYDYPKYEEESKLNRNEIKGVKLS

SEQ ID NO: 322 - protein, 35 aa, Artificial Sequence
  Core polypeptide
DECMNSVKNGTYDYPKYEEESKLNRNEIKGVKLSS

SEQ ID NO: 323 - protein, 35 aa, Artificial Sequence
  Core polypeptide
ECMNSVKNGTYDYPKYEEESKLNRNEIKGVKLSSM

SEQ ID NO: 324 - protein, 35 aa, Artificial Sequence
  Core polypeptide
CMNSVKNGTYDYPKYEEESKLNRNEIKGVKLSSMG

SEQ ID NO: 325 - protein, 35 aa, Artificial Sequence
  Core polypeptide
MNSVKNGTYDYPKYEEESKLNRNEIKGVKLSSMGV

SEQ ID NO: 326 - protein, 35 aa, Artificial Sequence
  Core polypeptide
NSVKNGTYDYPKYEEESKLNRNEIKGVKLSSMGVY

SEQ ID NO: 327 - protein, 35 aa, Artificial Sequence
  Core polypeptide
SVKNGTYDYPKYEEESKLNRNEIKGVKLSSMGVYQ

SEQ ID NO: 328 - protein, 35 aa, Artificial Sequence
  Core polypeptide
VKNGTYDYPKYEEESKLNRNEIKGVKLSSMGVYQI

SEQ ID NO: 329 - protein, 35 aa, Artificial Sequence
  Core polypeptide
KNGTYDYPKYEEESKLNRNEIKGVKLSSMGVYQIL

SEQ ID NO: 330 - protein, 13 aa, Artificial Sequence
  Core polypeptide
AFIRKSDELLHNV

SEQ ID NO: 331 - protein, 35 aa, Artificial Sequence
  Core polypeptide
VVLAGAALGVATAAQITAGIALHQSMLNSQAIDNL

SEQ ID NO: 332 - protein, 35 aa, Artificial Sequence
  Core polypeptide
VLAGAALGVATAAQITAGIALHQSMLNSQAIDNLR

SEQ ID NO: 333 - protein, 35 aa, Artificial Sequence
  Core polypeptide
LAGAALGVATAAQITAGIALHQSMLNSQAIDNLRA

SEQ ID NO: 334 - protein, 35 aa, Artificial Sequence
  Core polypeptide
AGAALGVATAAQITAGIALHQSMLNSQAIDNLRAS

SEQ ID NO: 335 - protein, 35 aa, Artificial Sequence
  Core polypeptide
GAALGVATAAQITAGIALHQSMLNSQAIDNLRASL

SEQ ID NO: 336 - protein, 35 aa, Artificial Sequence
  Core polypeptide
AALGVATAAQITAGIALHQSMLNSQAIDNLRASLE

SEQ ID NO: 337 - protein, 35 aa, Artificial Sequence
  Core polypeptide
ALGVATAAQITAGIALHQSMLNSQAIDNLRASLET

SEQ ID NO: 338 - protein, 35 aa, Artificial Sequence
  Core polypeptide
LGVATAAQITAGIALHQSMLNSQAIDNLRASLETT

SEQ ID NO: 339 - protein, 35 aa, Artificial Sequence
  Core polypeptide
GVATAAQITAGIALHQSMLNSQAIDNLRASLETTN

SEQ ID NO: 340 - protein, 35 aa, Artificial Sequence
  Core polypeptide
VATAAQITAGIALHQSMLNSQAIDNLRASLETTNQ

SEQ ID NO: 341 - protein, 35 aa, Artificial Sequence
  Core polypeptide
ATAAQITAGIALHQSMLNSQAIDNLRASLETTNQA

SEQ ID NO: 342 - protein, 35 aa, Artificial Sequence
  Core polypeptide
TAAQITAGIALHQSMLNSQAIDNLRASLETTNQAI

SEQ ID NO: 343 - protein, 35 aa, Artificial Sequence
  Core polypeptide
AAQITAGIALHQSMLNSQAIDNLRASLETTNQAIE

SEQ ID NO: 344 - protein, 35 aa, Artificial Sequence
  Core polypeptide
AQITAGIALHQSMLNSQAIDNLRASLETTNQAIEA

SEQ ID NO: 345 - protein, 35 aa, Artificial Sequence
  Core polypeptide
QITAGIALHQSMLNSQAIDNLRASLETTNQAIEAI

SEQ ID NO: 346 - protein, 35 aa, Artificial Sequence
  Core polypeptide
ITAGIALHQSMLNSQAIDNLRASLETTNQAIEAIR

SEQ ID NO: 347 - protein, 35 aa, Artificial Sequence
  Core polypeptide
TAGIALHQSMLNSQAIDNLRASLETTNQAIEAIRQ

SEQ ID NO: 348 - protein, 35 aa, Artificial Sequence
  Core polypeptide
AGIALHQSMLNSQAIDNLRASLETTNQAIEAIRQA

SEQ ID NO: 349 - protein, 35 aa, Artificial Sequence
  Core polypeptide
GIALHQSMLNSQAIDNLRASLETTNQAIEAIRQAG

SEQ ID NO: 350 - protein, 35 aa, Artificial Sequence
  Core polypeptide
IALHQSMLNSQAIDNLRASLETTNQAIEAIRQAGQ

SEQ ID NO: 351 - protein, 35 aa, Artificial Sequence
  Core polypeptide
ALHQSMLNSQAIDNLRASLETTNQAIEAIRQAGQE

SEQ ID NO: 352 - protein, 35 aa, Artificial Sequence
  Core polypeptide
LHQSMLNSQAIDNLRASLETTNQAIEAIRQAGQEM

SEQ ID NO: 353 - protein, 35 aa, Artificial Sequence
  Core polypeptide
HQSMLNSQAIDNLRASLETTNQAIEAIRQAGQEMI

SEQ ID NO: 354 - protein, 35 aa, Artificial Sequence
  Core polypeptide
QSMLNSQAIDNLRASLETTNQAIEAIRQAGQEMIL

SEQ ID NO: 355 - protein, 35 aa, Artificial Sequence
  Core polypeptide
SMLNSQAIDNLRASLETTNQAIEAIRQAGQEMILA

SEQ ID NO: 356 - protein, 35 aa, Artificial Sequence
  Core polypeptide
MLNSQAIDNLRASLETTNQAIEAIRQAGQEMILAV

SEQ ID NO: 357 - protein, 35 aa, Artificial Sequence
  Core polypeptide
LNSQAIDNLRASLETTNQAIEAIRQAGQEMILAVQ

SEQ ID NO: 358 - protein, 35 aa, Artificial Sequence
  Core polypeptide
NSQAIDNLRASLETTNQAIEAIRQAGQEMILAVQG

SEQ ID NO: 359 - protein, 35 aa, Artificial Sequence
  Core polypeptide
SQAIDNLRASLETTNQAIEAIRQAGQEMILAVQGV

SEQ ID NO: 360 - protein, 35 aa, Artificial Sequence
  Core polypeptide
QAIDNLRASLETTNQAIEAIRQAGQEMILAVQGVQ

SEQ ID NO: 361 - protein, 35 aa, Artificial Sequence
  Core polypeptide
AIDNLRASLETTNQAIEAIRQAGQEMILAVQGVQD

SEQ ID NO: 362 - protein, 35 aa, Artificial Sequence
  Core polypeptide
IDNLRASLETTNQAIEAIRQAGQEMILAVQGVQDY

SEQ ID NO: 363 - protein, 35 aa, Artificial Sequence
  Core polypeptide
DNLRASLETTNQAIEAIRQAGQEMILAVQGVQDYI

SEQ ID NO: 364 - protein, 35 aa, Artificial Sequence
  Core polypeptide
NLRASLETTNQAIEAIRQAGQEMILAVQGVQDYIN

SEQ ID NO: 365 - protein, 35 aa, Artificial Sequence
  Core polypeptide
LRASLETTNQAIEAIRQAGQEMILAVQGVQDYINN

SEQ ID NO: 366 - protein, 35 aa, Artificial Sequence
  Core polypeptide
RASLETTNQAIEAIRQAGQEMILAVQGVQDYINNE

SEQ ID NO: 367 - protein, 33 aa, Artificial Sequence
  Core polypeptide
YTSVITIELSNIKENKNGTDAVKLIKQELDKYK

SEQ ID NO: 368 - protein, 33 aa, Artificial Sequence
  Core polypeptide
TSVITIELSNIKENKNGTDAVKLIKQELDKYKN

SEQ ID NO: 369 - protein, 33 aa, Artificial Sequence
  Core polypeptide
SVITIELSNIKENKNGTDAVKLIKQELDKYKNA

SEQ ID NO: 370 - protein, 34 aa, Artificial Sequence
  Core polypeptide
SNIKENKNGTDAKVKLIKQELDKYKNAVTELQLL

SEQ ID NO: 371 - protein, 34 aa, Artificial Sequence
  Core polypeptide
KENKNGTDAKVKLIKQELDKYKNAVTELQLLMQS

SEQ ID NO: 372 - protein, 15 aa, Artificial Sequence
  Core polypeptide
CLELDKWASLWNWFC

SEQ ID NO: 373 - protein, 15 aa, Artificial Sequence
  Core polypeptide
CLELDKWASLANWFC

SEQ ID NO: 374 - protein, 15 aa, Artificial Sequence
  Core polypeptide
CLELDKWASLFNFFC

SEQ ID NO: 375 - protein, 36 aa, Artificial Sequence
  Core polypeptide
YTSLIHSLIEESQNQQEKNEQELLELDKWASLFNFF

SEQ ID NO: 376 - protein, 35 aa, Artificial Sequence
  Core polypeptide
RMKQLEDKVEELLSKNYHLENELELDKWASLWNWF

SEQ ID NO: 377 - protein, 28 aa, Artificial Sequence
  Core polypeptide
KVEELLSKNYHLENELELDKWASLWNWF

SEQ ID NO: 378 - protein, 29 aa, Artificial Sequence
  Core polypeptide
RMKQLEDKVEELLSKLEWIRRSNQKLDSI

SEQ ID NO: 379 - protein, 29 aa, Artificial Sequence
  Core polypeptide
RMKQLEDKVEELLSKLAFIRKSDELLHNV

SEQ ID NO: 380 - protein, 28 aa, Artificial Sequence
  Core polypeptide
ELEALRGELRALRGELELDKWASLWNWF

SEQ ID NO: 381 - protein, 34 aa, Artificial Sequence
  Core polypeptide
LDPIDISIELNKAKSDLEESKEWIRRSNQKLDSI

SEQ ID NO: 382 - protein, 16 aa, Artificial Sequence
  Core polypeptide
CNEQLSDSFPVEFFQV

SEQ ID NO: 383 - protein, 21 aa, Artificial Sequence
  Core polypeptide
MAEDDPYLGRPEQMFHLDPSL

SEQ ID NO: 384 - protein, 20 aa, Artificial Sequence
  Core polypeptide
EDFSSIADMDFSALLSQISS

SEQ ID NO: 385 - protein, 35 aa, Artificial Sequence
  Core polypeptide
TWQEWERKVDFLEENITALLEEAQIQQEKNMYELQ

SEQ ID NO: 386 - protein, 35 aa, Artificial Sequence
  Core polypeptide
WQEWERKVDFLEENITALLEEAQIQQEKNMYELQK

SEQ ID NO: 387 - protein, 35 aa, Artificial Sequence
  Core polypeptide
QEWERKVDFLEENITALLEEAQIQQEKNMYELQKL

SEQ ID NO: 388 - protein, 35 aa, Artificial Sequence
  Core polypeptide
EWERKVDFLEENITALLEEAQIQQEKNMYELQKLN

SEQ ID NO: 389 - protein, 35 aa, Artificial Sequence
  Core polypeptide
WERKVDFLEENITALLEEAQIQQEKNMYELQKLNS

SEQ ID NO: 390 - protein, 35 aa, Artificial Sequence
  Core polypeptide
ERKVDFLEENITALLEEAQIQQEKNMYELQKLNSW

SEQ ID NO: 391 - protein, 35 aa, Artificial Sequence
  Core polypeptide
RKVDFLEENITALLEEAQIQQEKNMYELQKLNSWD

SEQ ID NO: 392 - protein, 35 aa, Artificial Sequence
  Core polypeptide
KVDFLEENITALLEEAQIQQEKNMYELQKLNSWDV

SEQ ID NO: 393 - protein, 35 aa, Artificial Sequence
  Core polypeptide
VDFLEENITALLEEAQIQQEKNMYELQKLNSWDVF

SEQ ID NO: 394 - protein, 35 aa, Artificial Sequence
  Core polypeptide
DFLEENITALLEEAQIQQEKNMYELQKLNSWDVFG

SEQ ID NO: 395 - protein, 35 aa, Artificial Sequence
  Core polypeptide
FLEENITALLEEAQIQQEKNMYELQKLNSWDVFGN

SEQ ID NO: 396 - protein, 35 aa, Artificial Sequence
  Core polypeptide
LEENITALLEEAQIQQEKNMYELQKLNSWDVFGNW

SEQ ID NO: 397 - protein, 36 aa, Artificial Sequence
  Core polypeptide
LEENITALLEEAQIQQEKNMYELQKLNSWDVFGNWF

SEQ ID NO: 398 - protein, 36 aa, Artificial Sequence
  Core polypeptide
NEQSEEKENELYWAKEQLLDLLFNIFNQTVGAWIMQ

SEQ ID NO: 399 - protein, 33 aa, Artificial Sequence
  Core polypeptide
EWERKVDFLEENITALLEEAQIQQEKNMYEGGC

SEQ ID NO: 400 - protein, 38 aa, Artificial Sequence
  Core polypeptide
QQQLLDVVKRQQELLRLTVWGTKNLQTRVTAIEKYLKD

SEQ ID NO: 401 - protein, 38 aa, Artificial Sequence
  Core polypeptide
QQLLDVVKRQQELLRLTVWGTKNLQTRVTAIEKYLKDQ

SEQ ID NO: 402 - protein, 38 aa, Artificial Sequence
  Core polypeptide
QQLLDVVKRQQELLRLTVWGPKNLQTRVTAIEKYLKDQ

SEQ ID NO: 403 - protein, 38 aa, Artificial Sequence
  Core polypeptide
DERKQDKVLVVQQTGTLQLTLIQLEKTAKLQWVRLNRY

SEQ ID NO: 404 - protein, 35 aa, Artificial Sequence
  Core polypeptide
QQQLLDVVKRQQELLRLTVWGTKNLQTRVTAIEKY

SEQ ID NO: 405 - protein, 35 aa, Artificial Sequence
  Core polypeptide
QQLLDVVKRQQELLRLTVWGTKNLQTRVTAIEKYL

SEQ ID NO: 406 - protein, 35 aa, Artificial Sequence
  Core polypeptide
QLLDVVKRQQELLRLTVWGTKNLQTRVTAIEKYLK

SEQ ID NO: 407 - protein, 35 aa, Artificial Sequence
  Core polypeptide
LLDVVKRQQELLRLTVWGTKNLQTRVTAIEKYLKD

SEQ ID NO: 408 - protein, 35 aa, Artificial Sequence
  Core polypeptide
LDVVKRQQELLRLTVWGTKNLQTRVTAIEKYLKDQ

SEQ ID NO: 409 - protein, 35 aa, Artificial Sequence
  Core polypeptide
DVVKRQQELLRLTVWGTKNLQTRVTAIEKYLKDQA

SEQ ID NO: 410 - protein, 35 aa, Artificial Sequence
  Core polypeptide
VVKRQQELLRLTVWGTKNLQTRVTAIEKYLKDQAQ

SEQ ID NO: 411 - protein, 35 aa, Artificial Sequence
  Core polypeptide
VKRQQELLRLTVWGTKNLQTRVTAIEKYLKDQAQL

SEQ ID NO: 412 - protein, 35 aa, Artificial Sequence
  Core polypeptide
KRQQELLRLTVWGTKNLQTRVTAIEKYLKDQAQLN

SEQ ID NO: 413 - protein, 35 aa, Artificial Sequence
  Core polypeptide
RQQELLRLTVWGTKNLQTRVTAIEKYLKDQAQLNA

SEQ ID NO: 414 - protein, 35 aa, Artificial Sequence
  Core polypeptide
QQELLRLTVWGTKNLQTRVTAIEKYLKDQAQLNAW

SEQ ID NO: 415 - protein, 35 aa, Artificial Sequence
  Core polypeptide
QELLRLTVWGTKNLQTRVTAIEKYLKDQAQLNAWG

SEQ ID NO: 416 - protein, 35 aa, Artificial Sequence
  Core polypeptide
ELLRLTVWGTKNLQTRVTAIEKYLKDQAQLNAWGC

SEQ ID NO: 417 - protein, 38 aa, Artificial Sequence
  Core polypeptide
NNLLRAIEAQQHLLQLTVWGPKQLQARILAVERYLKDQ

SEQ ID NO: 418 - protein, 35 aa, Artificial Sequence
  Core polypeptide
SELEIKRYKNRVASRKCRAKFKQLLQHYREVAAAK

SEQ ID NO: 419 - protein, 35 aa, Artificial Sequence
  Core polypeptide
ELEIKRYKNRVASRKCRAKFKQLLQHYREVAAAKS

SEQ ID NO: 420 - protein, 35 aa, Artificial Sequence
  Core polypeptide
LEIKRYKNRVASRKCRAKFKQLLQHYREVAAAKSS

SEQ ID NO: 421 - protein, 35 aa, Artificial Sequence
  Core polypeptide
EIKRYKNRVASRKCRAKFKQLLQHYREVAAAKSSE

SEQ ID NO: 422 - protein, 35 aa, Artificial Sequence
  Core polypeptide
IKRYKNRVASRKCRAKFKQLLQHYREVAAAKSSEN

SEQ ID NO: 423 - protein, 35 aa, Artificial Sequence
  Core polypeptide
KRYKNRVASRKCRAKFKQLLQHYREVAAAKSSEND

SEQ ID NO: 424 - protein, 35 aa, Artificial Sequence
  Core polypeptide
RYKNRVASRKCRAKFKQLLQHYREVAAAKSSENDR

SEQ ID NO: 425 - protein, 35 aa, Artificial Sequence
  Core polypeptide
YKNRVASRKCRAKFKQLLQHYREVAAAKSSENDRL

SEQ ID NO: 426 - protein, 35 aa, Artificial Sequence
  Core polypeptide
KNRVASRKCRAKFKQLLQHYREVAAAKSSENDRLR

SEQ ID NO: 427 - protein, 35 aa, Artificial Sequence
  Core polypeptide
NRVASRKCRAKFKQLLQHYREVAAAKSSENDRLRL

SEQ ID NO: 428 - protein, 35 aa, Artificial Sequence
  Core polypeptide
RVASRKCRAKFKQLLQHYREVAAAKSSENDRLRLL

SEQ ID NO: 429 - protein, 35 aa, Artificial Sequence
  Core polypeptide
VASRKCRAKFKQLLQHYREVAAAKSSENDRLRLLL

SEQ ID NO: 430 - protein, 35 aa, Artificial Sequence
  Core polypeptide
ASRKCRAKFKQLLQHYREVAAAKSSENDRLRLLLK

SEQ ID NO: 431 - protein, 35 aa, Artificial Sequence
  Core polypeptide
SRKCRAKFKQLLQHYREVAAAKSSENDRLRLLLKQ

SEQ ID NO: 432 - protein, 35 aa, Artificial Sequence
  Core polypeptide
RKCRAKFKQLLQHYREVAAAKSSENDRLRLLLKQM

SEQ ID NO: 433 - protein, 35 aa, Artificial Sequence
  Core polypeptide
KCRAKFKQLLQHYREVAAAKSSENDRLRLLLKQMC

SEQ ID NO: 434 - protein, 35 aa, Artificial Sequence
  Core polypeptide
CRAKFKQLLQHYREVAAAKSSENDRLRLLLKQMCP

SEQ ID NO: 435 - protein, 35 aa, Artificial Sequence
  Core polypeptide
RAKFKQLLQHYREVAAAKSSENDRLRLLLKQMCPS

SEQ ID NO: 436 - protein, 35 aa, Artificial Sequence
  Core polypeptide
AKFKQLLQHYREVAAAKSSENDRLRLLLKQMCPSL

SEQ ID NO: 437 - protein, 35 aa, Artificial Sequence
  Core polypeptide
KFKQLLQHYREVAAAKSSENDRLRLLLKQMCPSLD

SEQ ID NO: 438 - protein, 35 aa, Artificial Sequence
  Core polypeptide
FKQLLQHYREVAAAKSSENDRLRLLLKQMCPSLDV

SEQ ID NO: 439 - protein, 35 aa, Artificial Sequence
  Core polypeptide
KQLLQHYREVAAAKSSENDRLRLLLKQMCPSLDVD

SEQ ID NO: 440 - protein, 35 aa, Artificial Sequence
  Core polypeptide
QLLQHYREVAAAKSSENDRLRLLLKQMCPSLDVDS

SEQ ID NO: 441 - protein, 35 aa, Artificial Sequence
  Core polypeptide
LLQHYREVAAAKSSENDRLRLLLKQMCPSLDVDSI

SEQ ID NO: 442 - protein, 35 aa, Artificial Sequence
  Core polypeptide
LQHYREVAAAKSSENDRLRLLLKQMCPSLDVDSII

SEQ ID NO: 443 - protein, 35 aa, Artificial Sequence
  Core polypeptide
QHYREVAAAKSSENDRLRLLLKQMCPSLDVDSIIP

SEQ ID NO: 444 - protein, 35 aa, Artificial Sequence
  Core polypeptide
HYREVAAAKSSENDRLRLLLKQMCPSLDVDSIIPR

SEQ ID NO: 445 - protein, 35 aa, Artificial Sequence
  Core polypeptide
YREVAAAKSSENDRLRLLLKQMCPSLDVDSIIPRT

SEQ ID NO: 446 - protein, 35 aa, Artificial Sequence
  Core polypeptide
REVAAAKSSENDRLRLLLKQMCPSLDVDSIIPRTP

SEQ ID NO: 447 - protein, 35 aa, Artificial Sequence
  Core polypeptide
EVAAAKSSENDRLRLLLKQMCPSLDVDSIIPRTPD

SEQ ID NO: 448 - protein, 35 aa, Artificial Sequence
  Core polypeptide
VAAAKSSENDRLRLLLKQMCPSLDVDSIIPRTPDV

SEQ ID NO: 449 - protein, 35 aa, Artificial Sequence
  Core polypeptide
AAAKSSENDRLRLLLKQMCPSLDVDSIIPRTPDVL

SEQ ID NO: 450 - protein, 35 aa, Artificial Sequence
  Core polypeptide
AAKSSENDRLRLLLKQMCPSLDVDSIIPRTPDVLH

SEQ ID NO: 451 - protein, 35 aa, Artificial Sequence
  Core polypeptide
AKSSENDRLRLLLKQMCPSLDVDSIIPRTPDVLHE

SEQ ID NO: 452 - protein, 35 aa, Artificial Sequence
  Core polypeptide
KSSENDRLRLLLKQMCPSLDVDSIIPRTPDVLHED

SEQ ID NO: 453 - protein, 35 aa, Artificial Sequence
  Core polypeptide
SSENDRLRLLLKQMCPSLDVDSIIPRTPDVLHEDL

SEQ ID NO: 454 - protein, 35 aa, Artificial Sequence
  Core polypeptide
SENDRLRLLLKQMCPSLDVDSIIPRTPDVLHEDLL

SEQ ID NO: 455 - protein, 35 aa, Artificial Sequence
  Core polypeptide
ENDRLRLLLKQMCPSLDVDSIIPRTPDVLHEDLLN

SEQ ID NO: 456 - protein, 35 aa, Artificial Sequence
  Core polypeptide
NDRLRLLLKQMCPSLDVDSIIPRTPDVLHEDLLNF

SEQ ID NO: 457 - protein, 35 aa, Artificial Sequence
  Core polypeptide
AAGSTMGARSMTLTVQARQLLSGIVQQQNNLLRAI

SEQ ID NO: 458 - protein, 35 aa, Artificial Sequence
  Core polypeptide
PGYRWMCLRRFIIFLFILLLCLIFLLVLLDYQGML

SEQ ID NO: 459 - protein, 35 aa, Artificial Sequence
  Core polypeptide
GYRWMCLRRFIIFLFILLLCLIFLLVLLDYQGMLP

SEQ ID NO: 460 - protein, 35 aa, Artificial Sequence
  Core polypeptide
YRWMCLRRFIIFLFILLLCLIFLLVLLDYQGMLPV

SEQ ID NO: 461 - protein, 35 aa, Artificial Sequence
  Core polypeptide
RWMCLRRFIIFLFILLLCLIFLLVLLDYQGMLPVC

SEQ ID NO: 462 - protein, 35 aa, Artificial Sequence
  Core polypeptide
WMCLRRFIIFLFILLLCLIFLLVLLDYQGMLPVCP

SEQ ID NO: 463 - protein, 35 aa, Artificial Sequence
  Core polypeptide
MCLRRFIIFLFILLLCLIFLLVLLDYQGMLPVCPL

SEQ ID NO: 464 - protein, 35 aa, Artificial Sequence
  Core polypeptide
CLRRFIIFLFILLLCLIFLLVLLDYQGMLPVCPLI

SEQ ID NO: 465 - protein, 35 aa, Artificial Sequence
  Core polypeptide
LRRFIIFLFILLLCLIFLLVLLDYQGMLPVCPLIP

SEQ ID NO: 466 - protein, 35 aa, Artificial Sequence
  Core polypeptide
RRFIIFLFILLLCLIFLLVLLDYQGMLPVCPLIPG

SEQ ID NO: 467 - protein, 35 aa, Artificial Sequence
  Core polypeptide
RFIIFLFILLLCLIFLLVLLDYQGMLPVCPLIPGS

SEQ ID NO: 468 - protein, 35 aa, Artificial Sequence
  Core polypeptide
FIIFLFILLLCLIFLLVLLDYQGMLPVCPLIPGSS

SEQ ID NO: 469 - protein, 35 aa, Artificial Sequence
  Core polypeptide
IIFLFILLLCLIFLLVLLDYQGMLPVCPLIPGSST

SEQ ID NO: 470 - protein, 35 aa, Artificial Sequence
  Core polypeptide
IFLFILLLCLIFLLVLLDYQGMLPVCPLIPGSSTT

SEQ ID NO: 471 - protein, 35 aa, Artificial Sequence
  Core polypeptide
FLFILLLCLIFLLVLLDYQGMLPVCPLIPGSSTTS

SEQ ID NO: 472 - protein, 35 aa, Artificial Sequence
  Core polypeptide
LFILLLCLIFLLVLLDYQGMLPVCPLIPGSSTTST

SEQ ID NO: 473 - protein, 35 aa, Artificial Sequence
  Core polypeptide
FILLLCLIFLLVLLDYQGMLPVCPLIPGSSTTSTG

SEQ ID NO: 474 - protein, 35 aa, Artificial Sequence
  Core polypeptide
ILLLCLIFLLVLLDYQGMLPVCPLIPGSSTTSTGP

SEQ ID NO: 475 - protein, 35 aa, Artificial Sequence
  Core polypeptide
LLLCLIFLLVLLDYQGMLPVCPLIPGSSTTSTGPC

SEQ ID NO: 476 - protein, 35 aa, Artificial Sequence
  Core polypeptide
LLCLIFLLVLLDYQGMLPVCPLIPGSSTTSTGPCR

SEQ ID NO: 477 - protein, 35 aa, Artificial Sequence
  Core polypeptide
LCLIFLLVLLDYQGMLPVCPLIPGSSTTSTGPCRT

SEQ ID NO: 478 - protein, 35 aa, Artificial Sequence
  Core polypeptide
CLIFLLVLLDYQGMLPVCPLIPGSSTTSTGPCRTC

SEQ ID NO: 479 - protein, 35 aa, Artificial Sequence
  Core polypeptide
LIFLLVLLDYQGMLPVCPLIPGSSTTSTGPCRTCM

SEQ ID NO: 480 - protein, 35 aa, Artificial Sequence
  Core polypeptide
IFLLVLLDYQGMLPVCPLIPGSSTTSTGPCRTCMT

SEQ ID NO: 481 - protein, 35 aa, Artificial Sequence
  Core polypeptide
FLLVLLDYQGMLPVCPLIPGSSTTSTGPCRTCMTT

SEQ ID NO: 482 - protein, 35 aa, Artificial Sequence
  Core polypeptide
PLLVLQAGFFLLTRILTIPQSLDSWWTSLNFLGGT

SEQ ID NO: 483 - protein, 35 aa, Artificial Sequence
  Core polypeptide
LLVLQAGFFLLTRILTIPQSLDSWWTSLNFLGGTT

SEQ ID NO: 484 - protein, 35 aa, Artificial Sequence
  Core polypeptide
LVLQAGFFLLTRILTIPQSLDSWWTSLNFLGGTTV

SEQ ID NO: 485 - protein, 35 aa, Artificial Sequence
  Core polypeptide
VLQAGFFLLTRILTIPQSLDSWWTSLNFLGGTTVC

SEQ ID NO: 486 - protein, 35 aa, Artificial Sequence
  Core polypeptide
LQAGFFLLTRILTIPQSLDSWWTSLNFLGGTTVCL

SEQ ID NO: 487 - protein, 35 aa, Artificial Sequence
  Core polypeptide
QAGFFLLTRILTIPQSLDSWWTSLNFLGGTTVCLG

SEQ ID NO: 488 - protein, 35 aa, Artificial Sequence
  Core polypeptide
AGFFLLTRILTIPQSLDSWWTSLNFLGGTTVCLGQ

SEQ ID NO: 489 - protein, 35 aa, Artificial Sequence
  Core polypeptide
GFFLLTRILTIPQSLDSWWTSLNFLGGTTVCLGQN

SEQ ID NO: 490 - protein, 35 aa, Artificial Sequence
  Core polypeptide
FFLLTRILTIPQSLDSWWTSLNFLGGTTVCLGQNS

SEQ ID NO: 491 - protein, 35 aa, Artificial Sequence
  Core polypeptide
FLLTRILTIPQSLDSWWTSLNFLGGTTVCLGQNSQ

SEQ ID NO: 492 - protein, 35 aa, Artificial Sequence
  Core polypeptide
LLTRILTIPQSLDSWWTSLNFLGGTTVCLGQNSQS

SEQ ID NO: 493 - protein, 35 aa, Artificial Sequence
  Core polypeptide
LTRILTIPQSLDSWWTSLNFLGGTTVCLGQNSQSP

SEQ ID NO: 494 - protein, 28 aa, Artificial Sequence
  Core polypeptide
FWNWLSAWKDLELKSLLEEVKDELQKMR

SEQ ID NO: 495 - protein, 19 aa, Artificial Sequence
  Core polypeptide
NNLLRAIEAQQHLLQLTVW

SEQ ID NO: 496 - protein, 41 aa, Artificial Sequence
  Core polypeptide
CGGNNLLRAIEAQQHLLQLTVWGIKQLQARILAVERYLKDQ

SEQ ID NO: 497 - protein, 36 aa, Artificial Sequence; identical to SEQ ID NO: 15
  Core polypeptide

SEQ ID NO: 498 - protein, 36 aa, Artificial Sequence; identical to SEQ ID NO: 15
  Core polypeptide

SEQ ID NO: 499 - protein, 35 aa, Artificial Sequence
  Core polypeptide
AVSKGYLSALRTGWYTSVITIELSNIKENKNGTDA

SEQ ID NO: 500 - protein, 36 aa, Artificial Sequence
  Core polypeptide
SISNIETVIEFQQKNNRLLEITREFSVNAGVTTPVS

SEQ ID NO: 501 - protein, 35 aa, Artificial Sequence
  Core polypeptide
DQQIKQYKRLLDRLIIPLYDGLRQKDVIVSNQESN

SEQ ID NO: 502 - protein, 36 aa, Artificial Sequence
  Core polypeptide
YSELTNIFGDNIGSLQEKGIKLQGIASLYRTNITEI

SEQ ID NO: 503 - protein, 36 aa, Artificial Sequence
  Core polypeptide
TSITLQVRLPLLTRLLNTQIYRVDSISYNIQNREWY

SEQ ID NO: 504 - protein, 35 aa, Artificial Sequence
  Core polypeptide
VEIAEYRRLLRTVLEPIRDALNAMTQNIRPVQSVA

SEQ ID NO: 505 - protein, 36 aa, Artificial Sequence
  Core polypeptide
SYFIVLSIAYPTLSEIKGVIVHRLEGVSYNIGSQEW

SEQ ID NO: 506 - protein, 28 aa, Artificial Sequence
  Core polypeptide
LKEAIRDTNKAVQSVQSSIGNLIVAIKS

SEQ ID NO: 507 - protein, 38 aa, Artificial Sequence; identical to SEQ ID NO: 16
  Core polypeptide

SEQ ID NO: 508 - protein, 16 aa, Artificial Sequence
  Core polypeptide
QKQEPIDKELYPLTSL

SEQ ID NO: 509 - protein, 14 aa, Artificial Sequence
  Core polypeptide
YPKFVKQNTLKLAT

SEQ ID NO: 510 - protein, 14 aa, Artificial Sequence
  Core polypeptide
QYIKANQKFIGITE

SEQ ID NO: 511 - protein, 14 aa, Artificial Sequence
  Core polypeptide
NGQIGNDPNRDILY

SEQ ID NO: 512 - protein, 6 aa, Artificial Sequence
  Core polypeptide
RPDVYH

SEQ ID NO: 513 - protein, 15 aa, Artificial Sequence
  Core polypeptide
CLELDKWASLWNWFC

SEQ ID NO: 514 - protein, 15 aa, Artificial Sequence
  Core polypeptide
CLELDKWASLANWFC

SEQ ID NO: 515 - protein, 15 aa, Artificial Sequence
  Core polypeptide
CLELDKWASLANFFC

SEQ ID NO: 516 - protein, 39 aa, Artificial Sequence
  Core polypeptide
NNLLRAIEAQQQHLLQLTVWGIKQLQARILAVERYLKDQ

SEQ ID NO: 517 - protein, 39 aa, Artificial Sequence
  Core polypeptide
CGGYTSLIHSLIEESQNQQEKNEQELLELDKWASLWNWF

SEQ ID NO: 518 - protein, 35 aa, Artificial Sequence; identical to SEQ ID NO: 482
  Core polypeptide

SEQ ID NO: 519 - protein, 35 aa, Artificial Sequence; identical to SEQ ID NO: 483
  Core polypeptide

SEQ ID NO: 520 - protein, 35 aa, Artificial Sequence; identical to SEQ ID NO: 484
  Core polypeptide

SEQ ID NO: 521 - protein, 35 aa, Artificial Sequence; identical to SEQ ID NO: 485
  Core polypeptide

SEQ ID NO: 522 - protein, 35 aa, Artificial Sequence; identical to SEQ ID NO: 486
  Core polypeptide

SEQ ID NO: 523 - protein, 35 aa, Artificial Sequence; identical to SEQ ID NO: 487
  Core polypeptide

SEQ ID NO: 524 - protein, 35 aa, Artificial Sequence; identical to SEQ ID NO: 488
  Core polypeptide

SEQ ID NO: 525 - protein, 35 aa, Artificial Sequence; identical to SEQ ID NO: 489
  Core polypeptide

SEQ ID NO: 526 - protein, 35 aa, Artificial Sequence; identical to SEQ ID NO: 490
  Core polypeptide

SEQ ID NO: 527 - protein, 35 aa, Artificial Sequence; identical to SEQ ID NO: 491
  Core polypeptide

SEQ ID NO: 528 - protein, 35 aa, Artificial Sequence; identical to SEQ ID NO: 492
  Core polypeptide

SEQ ID NO: 529 - protein, 35 aa, Artificial Sequence; identical to SEQ ID NO: 493
  Core polypeptide

SEQ ID NO: 530 - protein, 13 aa, Artificial Sequence
  Core polypeptide
LELDKWASLWNWA

SEQ ID NO: 531 - protein, 13 aa, Artificial Sequence
  Core polypeptide
LELDKWASAWNWF

SEQ ID NO: 532 - protein, 13 aa, Artificial Sequence
  Core polypeptide
LELDKAASLWNWF

SEQ ID NO: 533 - protein, 13 aa, Artificial Sequence
  Core polypeptide
LKLDKWASLWNWF

SEQ ID NO: 534 - protein, 13 aa, Artificial Sequence
  Core polypeptide
LELKKWASLWNWF

SEQ ID NO: 535 - protein, 13 aa, Artificial Sequence
  Core polypeptide
DELLHNVNAGKST

SEQ ID NO: 536 - protein, 15 aa, Artificial Sequence
  Core polypeptide
KSDELLHNVNAGKST

SEQ ID NO: 537 - protein, 17 aa, Artificial Sequence
  Core polypeptide
IRKSDELLHNVNAGKST

SEQ ID NO: 538 - protein, 19 aa, Artificial Sequence
  Core polypeptide
AFIRKSDELLHNVNAGKST

SEQ ID NO: 539 - protein, 19 aa, Artificial Sequence
  Core polypeptide
FDASISQVNEKINQSLAFI

SEQ ID NO: 540 - protein, 36 aa, Artificial Sequence
  Core polypeptide
YAADKESTQKAFDGITNKVNSVIEKMNTQFEAVGKE

SEQ ID NO: 541 - protein, 36 aa, Artificial Sequence
  Core polypeptide
SVIEKMNTQFEAVGKEFGNLERRLENLNKRMEDGFL

SEQ ID NO: 542 - protein, 36 aa, Artificial Sequence
  Core polypeptide
VWTYNAELLVLMENERTLDFHDSNVKNLYDKVRMQL

SEQ ID NO: 543 - protein, 33 aa, Artificial Sequence
  Core polypeptide
EWDREINNYTSLIHSLIEESQNQQEKNEQEGGC

SEQ ID NO: 544 - protein, 35 aa, Artificial Sequence
  Core polypeptide
INNYTSLIHSLIEESQNQQEKNEQELLELDKWASL

SEQ ID NO: 545 - protein, 28 aa, Artificial Sequence
  Core polypeptide
INNYTSLIHSLIEESQNQQEKNEQELLE

SEQ ID NO: 546 - protein, 35 aa, Artificial Sequence
  Core polypeptide
WMEWDREINNYTSLIHSLIEESQNQQEKNEQELLE

SEQ ID NO: 547 - protein, 48 aa, Artificial Sequence
  Core polypeptide
MTWMEWDREINNYTSLIHSLIEESQNQQEKNEQELLELDKWASLWNWF

SEQ ID NO: 548 - protein, 35 aa, Artificial Sequence
  Core polypeptide
IDISIELNKAKSDLEESKEWIKKSNQKLDSIGNWH

SEQ ID NO: 549 - protein, 36 aa, Artificial Sequence
  Core polypeptide
NQQEKNEQELLELDKWASLWNWFNITNWLWYIKIFI

SEQ ID NO: 550 - protein, 36 aa, Artificial Sequence
  Core polypeptide
QNQQEKNEQELLELDKWASLWNWFNITNWLWYIKIF

SEQ ID NO: 551 - protein, 36 aa, Artificial Sequence
  Core polypeptide
SQNQQEKNEQELLELDKWASLWNWFNITNWLWYIKI

SEQ ID NO: 552 - protein, 36 aa, Artificial Sequence
  Core polypeptide
ESQNQQEKNEQELLELDKWASLWNWFNITNWLWYIK

SEQ ID NO: 553 - protein, 36 aa, Artificial Sequence
  Core polypeptide
EESQNQQEKNEQELLELDKWASLWNWFNITNWLWYI

SEQ ID NO: 554 - protein, 36 aa, Artificial Sequence
  Core polypeptide
IEESQNQQEKNEQELLELDKWASLWNWFNITNWLWY

SEQ ID NO: 555 - protein, 36 aa, Artificial Sequence
  Core polypeptide
LIEESQNQQEKNEQELLELDKWASLWNWFNITNWLW

SEQ ID NO: 556 - protein, 36 aa, Artificial Sequence
  Core polypeptide
SLIEESQNQQEKNEQELLELDKWASLWNWFNITNWL

SEQ ID NO: 557 - protein, 36 aa, Artificial Sequence
  Core polypeptide
HSLIEESQNQQEKNEQELLELDKWASLWNWFNITNW

SEQ ID NO: 558 - protein, 36 aa, Artificial Sequence
  Core polypeptide
IHSLIEESQNQQEKNEQELLELDKWASLWNWFNITN

SEQ ID NO: 559 - protein, 36 aa, Artificial Sequence
  Core polypeptide
LIHSLIEESQNQQEKNEQELLELDKWASLWNWFNIT

SEQ ID NO: 560 - protein, 36 aa, Artificial Sequence
  Core polypeptide
SLIHSLIEESQNQQEKNEQELLELDKWASLWNWFNI

SEQ ID NO: 561 - protein, 36 aa, Artificial Sequence
  Core polypeptide
TSLIHSLIEESQNQQEKNEQELLELDKWASLWNWFN

SEQ ID NO: 562 - protein, 36 aa, Artificial Sequence
  Core polypeptide
NYTSLIHSLIEESQNQQEKNEQELLELDKWASLWNW

SEQ ID NO: 563 - protein, 36 aa, Artificial Sequence
  Core polypeptide
NNYTSLIHSLIEESQNQQEKNEQELLELDKWASLWN

SEQ ID NO: 564 - protein, 36 aa, Artificial Sequence
  Core polypeptide
INNYTSLIHSLIEESQNQQEKNEQELLELDKWASLW

SEQ ID NO: 565 - protein, 36 aa, Artificial Sequence
  Core polypeptide
EINNYTSLIHSLIEESQNQQEKNEQELLELDKWASL

SEQ ID NO: 566 - protein, 36 aa, Artificial Sequence
  Core polypeptide
REINNYTSLIHSLIEESQNQQEKNEQELLELDKWAS

SEQ ID NO: 567 - protein, 36 aa, Artificial Sequence
  Core polypeptide
DREINNYTSLIHSLIEESQNQQEKNEQELLELDKWA

SEQ ID NO: 568 - protein, 36 aa, Artificial Sequence
  Core polypeptide
WDREINNYTSLIHSLIEESQNQQEKNEQELLELDKW

SEQ ID NO: 569 - protein, 36 aa, Artificial Sequence
  Core polypeptide
EWDREINNYTSLIHSLIEESQNQQEKNEQELLELDK

SEQ ID NO: 570 - protein, 38 aa, Artificial Sequence
  Core polypeptide
MEWDREINNYTSLIHSLIEESQNQQEKNEQELLELDNH

SEQ ID NO: 571 - protein, 36 aa, Artificial Sequence
  Core polypeptide
MEWDREINNYTSLIHSLIEESQNQQEKNEQELLELD

SEQ ID NO: 572 - protein, 36 aa, Artificial Sequence
  Core polypeptide
WMEWDREINNYTSLIHSLIEESQNQQEKNEQELLEL

SEQ ID NO: 573 - protein, 36 aa, Artificial Sequence
  Core polypeptide
TWMEWDREINNYTSLIHSLIEESQNQQEKNEQELLE

SEQ ID NO: 574 - protein, 36 aa, Artificial Sequence
  Core polypeptide
MTWMEWDREINNYTSLIHSLIEESQNQQEKNEQELL

SEQ ID NO: 575 - protein, 36 aa, Artificial Sequence
  Core polypeptide
NMTWMEWDREINNYTSLIHSLIEESQNQQEKNEQEL

SEQ ID NO: 576 - protein, 36 aa, Artificial Sequence
  Core polypeptide
NNMTWMEWDREINNYTSLIHSLIEESQNQQEKNEQE

SEQ ID NO: 577 - protein, 36 aa, Artificial Sequence
  Core polypeptide
WNNMTWMEWDREINNYTSLIHSLIEESQNQQEKNEQ

SEQ ID NO: 578 - protein, 36 aa, Artificial Sequence
  Core polypeptide
IWNNMTWMEWDREINNYTSLIHSLIEESQNQQEKNE

SEQ ID NO: 579 - protein, 36 aa, Artificial Sequence
  Core polypeptide
QIWNNMTWMEWDREINNYTSLIHSLIEESQNQQEKN

SEQ ID NO: 580 - protein, 36 aa, Artificial Sequence
  Core polypeptide
EQIWNNMTWMEWDREINNYTSLIHSLIEESQNQQEK

SEQ ID NO: 581 - protein, 36 aa, Artificial Sequence
  Core polypeptide
LEQIWNNMTWMEWDREINNYTSLIHSLIEESQNQQE

SEQ ID NO: 582 - protein, 36 aa, Artificial Sequence
  Core polypeptide
SLEQIWNNMTWMEWDREINNYTSLIHSLIEESQNQQ

SEQ ID NO: 583 - protein, 36 aa, Artificial Sequence
  Core polypeptide
KSLEQIWNNMTWMEWDREINNYTSLIHSLIEESQNQ

SEQ ID NO: 584 - protein, 36 aa, Artificial Sequence
  Core polypeptide
NKSLEQIWNNMTWMEWDREINNYTSLIHSLIEESQN

SEQ ID NO: 585 - protein, 21 aa, Artificial Sequence
  Core polypeptide
SLAFIRKSDELLHNVNAGKST

SEQ ID NO: 586 - protein, 21 aa, Artificial Sequence
  Core polypeptide
FDASISQVNEKINQSLAFIRK

SEQ ID NO: 587 - protein, 36 aa, Artificial Sequence
  Core polypeptide
YTSLIHSLIEESQQQQEKQEQELLELDKWASLWNWF

SEQ ID NO: 588 - protein, 33 aa, Artificial Sequence
  Core polypeptide
FDASISQVNEKINQSLAFIRKSDELLHNVNAGK

SEQ ID NO: 589 - protein, 31 aa, Artificial Sequence
  Core polypeptide
FDASISQVNEKINQSLAFIRKSDELLHNVNA

SEQ ID NO: 590 - protein, 29 aa, Artificial Sequence
  Core polypeptide
FDASISQVNEKINQSLAFIRKSDELLHNV

SEQ ID NO: 591 - protein, 27 aa, Artificial Sequence
  Core polypeptide
FDASISQVNEKINQSLAFIRKSDELLH

SEQ ID NO: 592 - protein, 25 aa, Artificial Sequence
  Core polypeptide
FDASISQVNEKINQSLAFIRKSDEL

SEQ ID NO: 593 - protein, 23 aa, Artificial Sequence
  Core polypeptide
FDASISQVNEKINQSLAFIRKSD

SEQ ID NO: 594 - protein, 33 aa, Artificial Sequence
  Core polypeptide
ASISQVNEKINQSLAFIRKSDELLHNVNAGKST

SEQ ID NO: 595 - protein, 31 aa, Artificial Sequence
  Core polypeptide
ISQVNEKINQSLAFIRKSDELLHNVNAGKST

SEQ ID NO: 596 - protein, 29 aa, Artificial Sequence
  Core polypeptide
QVNEKINQSLAFIRKSDELLHNVNAGKST

SEQ ID NO: 597 - protein, 27 aa, Artificial Sequence
  Core polypeptide
NEKINQSLAFIRKSDELLHNVNAGKST

SEQ ID NO: 598 - protein, 25 aa, Artificial Sequence
  Core polypeptide
KINQSLAFIRKSDELLHNVNAGKST

SEQ ID NO: 599 - protein, 23 aa, Artificial Sequence
  Core polypeptide
NQSLAFIRKSDELLHNVNAGKST

SEQ ID NO: 600 - protein, 30 aa, Artificial Sequence
  Core polypeptide
FWNWLSAWKDLELYPGSLELDKWASLWNWF

SEQ ID NO: 601 - protein, 41 aa, Artificial Sequence; identical to SEQ ID NO: 496
  Core polypeptide

SEQ ID NO: 602 - protein, 39 aa, Artificial Sequence; identical to SEQ ID NO: 517
  Core polypeptide

SEQ ID NO: 603 - protein, 36 aa, Artificial Sequence; identical to SEQ ID NO: 15
  Core polypeptide

SEQ ID NO: 604 - protein, 38 aa, Artificial Sequence; identical to SEQ ID NO: 16
  Core polypeptide

SEQ ID NO: 605 - protein, 36 aa, Artificial Sequence
  Core polypeptide
EKNMYELQKLNSWDVFTNWLDFTSWVRYIQYIQYGV

SEQ ID NO: 606 - protein, 36 aa, Artificial Sequence
  Core polypeptide
QEKNMYELQKLNSWDVFTNWLDFTSWVRYIQYIQYG

SEQ ID NO: 607 - protein, 36 aa, Artificial Sequence
  Core polypeptide
QQEKNMYELQKLNSWDVFTNWLDFTSWVRYIQYIQY

SEQ ID NO: 608 - protein, 36 aa, Artificial Sequence
  Core polypeptide
IQQEKNMYELQKLNSWDVFTNWLDFTSWVRYIQYIQ

SEQ ID NO: 609 - protein, 36 aa, Artificial Sequence
  Core polypeptide
QIQQEKNMYELQKLNSWDVFTNWLDFTSWVRYIQYI

SEQ ID NO: 610 - protein, 36 aa, Artificial Sequence
  Core polypeptide
AQIQQEKNMYELQKLNSWDVFTNWLDFTSWVRYIQY

SEQ ID NO: 611 - protein, 36 aa, Artificial Sequence
  Core polypeptide
QAQIQQEKNMYELQKLNSWDVFTNWLDFTSWVRYIQ

SEQ ID NO: 612 - protein, 36 aa, Artificial Sequence
  Core polypeptide
EQAQIQQEKNMYELQKLNSWDVFTNWLDFTSWVRYI

SEQ ID NO: 613 - protein, 36 aa, Artificial Sequence
  Core polypeptide
LEQAQIQQEKNMYELQKLNSWDVFTNWLDFTSWVRY

SEQ ID NO: 614 - protein, 36 aa, Artificial Sequence
  Core polypeptide
SLEQAQIQQEKNMYELQKLNSWDVFTNWLDFTSWVR

SEQ ID NO: 615 - protein, 36 aa, Artificial Sequence
  Core polypeptide
QSLEQAQIQQEKNMYELQKLNSWDVFTNWLDFTSWV

SEQ ID NO: 616 - protein, 36 aa, Artificial Sequence
  Core polypeptide
SQSLEQAQIQQEKNMYELQKLNSWDVFTNWLDFTSW

SEQ ID NO: 617 - protein, 36 aa, Artificial Sequence
  Core polypeptide
ISQSLEQAQIQQEKNMYELQKLNSWDVFTNWLDFTS

SEQ ID NO: 618 - protein, 36 aa, Artificial Sequence
  Core polypeptide
NISQSLEQAQIQQEKNMYELQKLNSWDVFTNWLDFT

SEQ ID NO: 619 - protein, 36 aa, Artificial Sequence
  Core polypeptide
ANISQSLEQAQIQQEKNMYELQKLNSWDVFTNWLDF

SEQ ID NO: 620 - protein, 36 aa, Artificial Sequence
  Core polypeptide
EANISQSLEQAQIQQEKNMYELQKLNSWDVFTNWLD

SEQ ID NO: 621 - protein, 36 aa, Artificial Sequence
  Core polypeptide
LEANISQSLEQAQIQQEKNMYELQKLNSWDVFTNWL

SEQ ID NO: 622 - protein, 36 aa, Artificial Sequence
  Core polypeptide
YLEANISQSLEQAQIQQEKNMYELQKLNSWDVFTNW

SEQ ID NO: 623 - protein, 23 aa, Artificial Sequence
  Core polypeptide
YTSLIHSLIEESQNQQEKNEQEL

SEQ ID NO: 624 - protein, 36 aa, Artificial Sequence
  Core polypeptide
YTSLIHSLIEESQNLQEKNEQELLELDKWASLWNWF

SEQ ID NO: 625 - protein, 36 aa, Artificial Sequence
  Core polypeptide
YTSLIHSLIEESQNQQEKLEQELLELDKWASLWNWF

SEQ ID NO: 626 - protein, 36 aa, Artificial Sequence
  Core polypeptide
YTSLIHSLIEESQNQQEKNEQELLEFDKWASLWNWF

SEQ ID NO: 627 - protein, 36 aa, Artificial Sequence
  Core polypeptide
YTSLIHSLIEESQNQQEKNEQELLELDKPASLWNWF

SEQ ID NO: 628 - protein, 36 aa, Artificial Sequence
  Core polypeptide
YTSLIHSLIEESQNQQEKNEQELLELDKWASPWNWF

SEQ ID NO: 629 - protein, 36 aa, Artificial Sequence
  Core polypeptide
YTSLIHSLIEESQNQQEKNEQELLELDKWASLWNSF

SEQ ID NO: 630 - protein, 36 aa, Artificial Sequence; identical to SEQ ID NO: 15
  Core polypeptide

SEQ ID NO: 631 - protein, 36 aa, Artificial Sequence; identical to SEQ ID NO: 15
  Core polypeptide

SEQ ID NO: 632 - protein, 39 aa, Artificial Sequence
  Core polypeptide
FMCYTSLIHSLIEESQNQQEKNEQELLELDKWASLWNWF

SEQ ID NO: 633 - protein, 41 aa, Artificial Sequence
  Core polypeptide
FMCNNLLRAIEAQQHLLQLTVWGIKQLQARILAVERYLKDQ

SEQ ID NO: 634 - protein, 30 aa, Artificial Sequence
  Core polypeptide
EWDREINNYTSLIHSLIEESQNQQEKNEQE

SEQ ID NO: 635 - protein, 29 aa, Artificial Sequence
  Core polypeptide
LIEESQNQQEKNEQELLELDKWASLWNWF

SEQ ID NO: 636 - protein, 35 aa, Artificial Sequence
  Core polypeptide
FWNWLSAWKDLELGGPGSGPGGLELDKWASLWNWF

SEQ ID NO: 637 - protein, 29 aa, Artificial Sequence
  Core polypeptide
LIHSLIEESQNQQEKNEQELLELDKWASL

SEQ ID NO: 638 - protein, 35 aa, Artificial Sequence
  Core polypeptide
TSLIHSLIEESQNQQEKNEQELLELDKWASLWNWF

SEQ ID NO: 639 - protein, 33 aa, Artificial Sequence; identical to SEQ ID NO: 61
  Core polypeptide

SEQ ID NO: 640 - protein, 41 aa, Artificial Sequence
  Core polypeptide
GGGGGYTSLIHSLIEESQNQQEKNEQELLELDKWASLWNWF

SEQ ID NO: 641 - protein, 31 aa, Artificial Sequence
  Core polypeptide
HSLIEESQNQQEKNEQELLELDKWASLWNWF

SEQ ID NO: 642 - protein, 36 aa, Artificial Sequence
  Core polypeptide
YTSLIYSLIEESQNQQEKNEQELLELDKWASLWNWF

SEQ ID NO: 643 - protein, 36 aa, Artificial Sequence
  Core polypeptide
YTSLIHSLIEKSQNQQEKNEQELLELDKWASLWNWF

SEQ ID NO: 644 - protein, 36 aa, Artificial Sequence
  Core polypeptide
YTSLIHSSIEESQNQQEKNEQELLELDKWASLWNWF

SEQ ID NO: 645 - protein, 36 aa, Artificial Sequence
  Core polypeptide
LEANISQLLEQAQIQQEKNMYELQKLNSWDVFTNWL

SEQ ID NO: 646 - protein, 35 aa, Artificial Sequence
  Core polypeptide
SLEECDSELEIKRYKNRVASRKCRAKFKQLLQHYR

SEQ ID NO: 647 - protein, 35 aa, Artificial Sequence
  Core polypeptide
LEECDSELEIKRYKNRVASRKCRAKFKQLLQHYRE

SEQ ID NO: 648 - protein, 35 aa, Artificial Sequence
  Core polypeptide
EECDSELEIKRYKNRVASRKCRAKFKQLLQHYREV

SEQ ID NO: 649 - protein, 35 aa, Artificial Sequence
  Core polypeptide
ECDSELEIKRYKNRVASRKCRAKFKQLLQHYREVA

SEQ ID NO: 650 - protein, 35 aa, Artificial Sequence
  Core polypeptide
CDSELEIKRYKNRVASRKCRAKFKQLLQHYREVAA

SEQ ID NO: 651 - protein, 35 aa, Artificial Sequence
  Core polypeptide
DSELEIKRYKNRVASRKCRAKFKQLLQHYREVAAA

SEQ ID NO: 652 - protein, 49 aa, Artificial Sequence
  Core polypeptide
DESAMINTYRSINEFDASISQVNEKINQSLAFIRKSDELLHNVNAGKST

SEQ ID NO: 653 - protein, 7 aa, Artificial Sequence
  Core polypeptide
WASLWNW

SEQ ID NO: 654 - protein, 38 aa, Artificial Sequence
  Core polypeptide
EAQQHLLQLTVWGIKQLQARILAVERYLKDQQLLGIWG

SEQ ID NO: 655 - protein, 38 aa, Artificial Sequence
  Core polypeptide
IEAQQHLLQLTVWGIKQLQARILAVERYLKDQQLLGIW

SEQ ID NO: 656 - protein, 38 aa, Artificial Sequence
  Core polypeptide
AIEAQQHLLQLTVWGIKQLQARILAVERYLKDQQLLGI

SEQ ID NO: 657 - protein, 38 aa, Artificial Sequence
  Core polypeptide
RAIEAQQHLLQLTVWGIKQLQARILAVERYLKDQQLLG

SEQ ID NO: 658 - protein, 38 aa, Artificial Sequence
  Core polypeptide
LRAIEAQQHLLQLTVWGIKQLQARILAVERYLKDQQLL

SEQ ID NO: 659 - protein, 38 aa, Artificial Sequence
  Core polypeptide
LLRAIEAQQHLLQLTVWGIKQLQARILAVERYLKDQQL

SEQ ID NO: 660 - protein, 38 aa, Artificial Sequence
  Core polypeptide
NLLRAIEAQQHLLQLTVWGIKQLQARILAVERYLKDQQ

SEQ ID NO: 661 - protein, 38 aa, Artificial Sequence
  Core polypeptide
QNNLLRAIEAQQHLLQLTVWGIKQLQARILAVERYLKD

SEQ ID NO: 662 - protein, 38 aa, Artificial Sequence
  Core polypeptide
QQNNLLRAIEAQQHLLQLTVWGIKQLQARILAVERYLK

SEQ ID NO: 663 - protein, 38 aa, Artificial Sequence
  Core polypeptide
QQQNNLLRAIEAQQHLLQLTVWGIKQLQARILAVERYL

SEQ ID NO: 664 - protein, 38 aa, Artificial Sequence
  Core polypeptide
VQQQNNLLRAIEAQQHLLQLTVWGIKQLQARILAVERY

SEQ ID NO: 665 - protein, 38 aa, Artificial Sequence
  Core polypeptide
IVQQQNNLLRAIEAQQHLLQLTVWGIKQLQARILAVER

SEQ ID NO: 666 - protein, 38 aa, Artificial Sequence
  Core polypeptide
GIVQQQNNLLRAIEAQQHLLQLTVWGIKQLQARILAVE

SEQ ID NO: 667 - protein, 38 aa, Artificial Sequence
  Core polypeptide
SGIVQQQNNLLRAIEAQQHLLQLTVWGIKQLQARILAV

SEQ ID NO: 668 - protein, 38 aa, Artificial Sequence
  Core polypeptide
RSMTLTVQARQLLSGIVQQQNNLLRAIEAQQHLLQLTV

SEQ ID NO: 669 - protein, 38 aa, Artificial Sequence
  Core polypeptide
GARSMTLTVQARQLLSGIVQQQNNLLRAIEAQQHLLQL

SEQ ID NO: 670 - protein, 38 aa, Artificial Sequence
  Core polypeptide
GSTMGARSMTLTVQARQLLSGIVQQQNNLLRAIEAQQH

SEQ ID NO: 671 - protein, 38 aa, Artificial Sequence; identical to SEQ ID NO: 670
  Core polypeptide

SEQ ID NO: 672 - protein, 38 aa, Artificial Sequence
  Core polypeptide
EGSTMGARSMTLTVQARQLLSGIVQQQNNLLRAIEAQQ

SEQ ID NO: 673 - protein, 28 aa, Artificial Sequence
  Core polypeptide
RAKFKQLLQHYREVAAAKSSENDRLRLL

SEQ ID NO: 674 - protein, 28 aa, Artificial Sequence
  Core polypeptide
AKFKQLLQHYREVAAAKSSENDRLRLLL

SEQ ID NO: 675 - protein, 28 aa, Artificial Sequence
  Core polypeptide
KFKQLLQHYREVAAAKSSENDRLRLLLK

SEQ ID NO: 676 - protein, 28 aa, Artificial Sequence
  Core polypeptide
FKQLLQHYREVAAAKSSENDRLRLLLKQ

SEQ ID NO: 677 - protein, 35 aa, Artificial Sequence
  Core polypeptide
RAKFKQELQHYREVAAAKSSENDRLRLLLKQMCPS

SEQ ID NO: 678 - protein, 10 aa, Artificial Sequence
  Core polypeptide
DKWASLWNWF

SEQ ID NO: 679 - protein, 35 aa, Artificial Sequence; identical to SEQ ID NO: 114
  Core polypeptide

SEQ ID NO: 680 - protein, 35 aa, Artificial Sequence
  Core polypeptide
YDASISQVNEKINQSLAFIRKSDELLHNVNAGKST

SEQ ID NO: 681 - protein, 35 aa, Artificial Sequence
  Core polypeptide
YDASISQVNEKINQSLAYIRKSDELLHNVNAGKST

SEQ ID NO: 682 - protein, 35 aa, Artificial Sequence
  Core polypeptide
FDASISQVNEKINQSLAYIRKSDELLHNVNAGKST

SEQ ID NO: 683 - protein, 35 aa, Artificial Sequence
  Core polypeptide
FDASISQVQEKIQQSLAFIRKSDELLHQVQAGKST

SEQ ID NO: 684 - protein, 35 aa, Artificial Sequence
  Core polypeptide
FDASISQVNEKINQALAFIRKADELLHNVNAGKST

SEQ ID NO: 685 - protein, 35 aa, Artificial Sequence
  Core polypeptide
FDASISQVNEKINQALAFIRKSDELLHNVNAGKST

SEQ ID NO: 686 - protein, 35 aa, Artificial Sequence
  Core polypeptide
FDASISQVNEKINQSLAFIRKADELLHNVNAGKST

SEQ ID NO: 687 - protein, 35 aa, Artificial Sequence
  Core polypeptide
YDASISQVQEEIQQALAFIRKADELLEQVQAGKST

SEQ ID NO: 688 - protein, 35 aa, Artificial Sequence
  Core polypeptide
FDASISQVNEKINQSLAFIRKSDELLENVNAGKST

SEQ ID NO: 689 - protein, 35 aa, Artificial Sequence
  Core polypeptide
FDASISQVNEEINQSLAFIRKSDELLHNVNAGKST

SEQ ID NO: 690 - protein, 35 aa, Artificial Sequence
  Core polypeptide
VFPSDEFDASISQVNEKINQSLAFIRKSDELLENV

SEQ ID NO: 691 - protein, 35 aa, Artificial Sequence
  Core polypeptide
VFPSDEFDASISQVNEEINQSLAFIRKSDELLENV

SEQ ID NO: 692 - protein, 35 aa, Artificial Sequence
  Core polypeptide
VYPSDEYDASISQVNEEINQALAYIRKADELLENV

SEQ ID NO: 693 - protein, 35 aa, Artificial Sequence
  Core polypeptide
VFPSDEFDASISQVNEEINQSLAFIRKSDELLHNV

SEQ ID NO: 694 - protein, 36 aa, Artificial Sequence
  Core polypeptide
SNKSLEQIWNNMTWMEWDREINNYTSLIHSLIEESQ

SEQ ID NO: 695 - protein, 36 aa, Artificial Sequence
  Core polypeptide
WSNKSLEQIWNNMTWMEWDREINNYTSLIHSLIEES

SEQ ID NO: 696 - protein, 36 aa, Artificial Sequence
  Core polypeptide
SWSNKSLEQIWNNMTWMEWDREINNYTSLIHSLIEE

SEQ ID NO: 697 - protein, 36 aa, Artificial Sequence
  Core polypeptide
ASWSNKSLEQIWNNMTWMEWDREINNYTSLIHSLIE

SEQ ID NO: 698 - protein, 36 aa, Artificial Sequence
  Core polypeptide
NASWSNKSLEQIWNNMTWMEWDREINNYTSLIHSLI

SEQ ID NO: 699 - protein, 36 aa, Artificial Sequence
  Core polypeptide
WNASWSNKSLEQIWNNMTWMEWDREINNYTSLIHSL

SEQ ID NO: 700 - protein, 36 aa, Artificial Sequence
  Core polypeptide
PWNASWSNKSLEQIWNNMTWMEWDREINNYTSLIHS

SEQ ID NO: 701 - protein, 36 aa, Artificial Sequence
  Core polypeptide
VPWNASWSNKSLEQIWNNMTWMEWDREINNYTSLIH

SEQ ID NO: 702 - protein, 36 aa, Artificial Sequence
  Core polypeptide
AVPWNASWSNKSLEQIWNNMTWMEWDREINNYTSLI

SEQ ID NO: 703 - protein, 36 aa, Artificial Sequence
  Core polypeptide
TAVPWNASWSNKSLEQIWNNMTWMEWDREINNYTSL

SEQ ID NO: 704 - protein, 36 aa, Artificial Sequence
  Core polypeptide
TTAVPWNASWSNKSLEQIWNNMTWMEWDREINNYTS

SEQ ID NO: 705 - protein, 36 aa, Artificial Sequence; identical to SEQ ID NO: 15
  Core polypeptide

SEQ ID NO: 706 - protein, 35 aa, Artificial Sequence
  Core polypeptide
AAASDEFDASISQVNEKINQSLAFIRKSDELLHNV

SEQ ID NO: 707 - protein, 35 aa, Artificial Sequence
  Core polypeptide
VFPAAAFDASISQVNEKINQSLAFIRKSDELLHNV

SEQ ID NO: 708 - protein, 35 aa, Artificial Sequence
  Core polypeptide
VFPSDEAAASISQVNEKINQSLAFIRKSDELLHNV

SEQ ID NO: 709 - protein, 35 aa, Artificial Sequence
  Core polypeptide
VFPSDEFDAAAAQVNEKINQSLAFIRKSDELLHNV

SEQ ID NO: 710 - protein, 35 aa, Artificial Sequence
  Core polypeptide
VFPSDEFDASISAAAEKINQSLAFIRKSDELLHNV

SEQ ID NO: 711 - protein, 35 aa, Artificial Sequence
  Core polypeptide
VFPSDEFDASISQVNAAANQSLAFIRKSDELLHNV

SEQ ID NO: 712 - protein, 35 aa, Artificial Sequence
  Core polypeptide
VFPSDEFDASISQVNEKIAAALAFIRKSDELLHNV

SEQ ID NO: 713 - protein, 35 aa, Artificial Sequence
  Core polypeptide
VFPSDEFDASISQVNEKINQSAAAIRKSDELLHNV

SEQ ID NO: 714 - protein, 35 aa, Artificial Sequence
  Core polypeptide
VFPSDEFDASISQVNEKINQSLAFAAASDELLHNV

SEQ ID NO: 715 - protein, 35 aa, Artificial Sequence
  Core polypeptide
VFPSDEFDASISQVNEKINQSLAFIRKAAALLHNV

SEQ ID NO: 716 - protein, 35 aa, Artificial Sequence
  Core polypeptide
VFPSDEFDASISQVNEKINQSLAFIRKSDEAAANV

SEQ ID NO: 717 - protein, 35 aa, Artificial Sequence
  Core polypeptide
VFPSDEFDASISQVNEKINQSLAFIRKSDELLAAA

SEQ ID NO: 718 - protein, 35 aa, Artificial Sequence
  Core polypeptide
VYPSDEFDASISQVNEKINQSLAFIRKSDELLHNV

SEQ ID NO: 719 - protein, 36 aa, Artificial Sequence
  Core polypeptide
AAAAIHSLIEESQNQQEKNEQELLELDKWASLWNWF

SEQ ID NO: 720 - protein, 36 aa, Artificial Sequence
  Core polypeptide
YTSLIHSLIEESQQQQEKNEQELLELDKWASLWNWF

SEQ ID NO: 721 - protein, 36 aa, Artificial Sequence
  Core polypeptide
YTSLIHSLIEESQNQQEKQEQELLELDKWASLWNWF

SEQ ID NO: 722 - protein, 36 aa, Artificial Sequence
  Core polypeptide
QIWNNMTWMEWDREINNYTSLIHSLIEESQNQQEKQ

SEQ ID NO: 723 - protein, 36 aa, Artificial Sequence
  Core polypeptide
QIWNNMTWMEWDREINNYTSLIHSLIEESQQQQEKN

SEQ ID NO: 724 - protein, 36 aa, Artificial Sequence
  Core polypeptide
QIWNNMTWMEWDREINNYTSLIHSLIEESQQQQEKQ

SEQ ID NO: 725 - protein, 36 aa, Artificial Sequence
  Core polypeptide
NKSLEQIWNNMTWMEWDREINNYTSLIHSLIEESQQ

SEQ ID NO: 726 - protein, 35 aa, Artificial Sequence
  Core polypeptide
FDASISQVNEKINQSLAFIEESDELLHNVNAGKST

SEQ ID NO: 727 - protein, 9 aa, Artificial Sequence
  Core polypeptide
IRKSDELCL

SEQ ID NO: 728 - protein, 36 aa, Artificial Sequence
  Core polypeptide
YTSLIHSLIEESQNQQEKDEQELLELDKWASLWNWF

SEQ ID NO: 729 - protein, 36 aa, Artificial Sequence
  Core polypeptide
YTSLIHSLIEESQDQQEKNEQELLELDKWASLWNWF

SEQ ID NO: 730 - protein, 36 aa, Artificial Sequence
  Core polypeptide
YTSLIHSLIEESQDQQEKDEQELLELDKWASLWNWF

SEQ ID NO: 731 - protein, 36 aa, Artificial Sequence
  Core polypeptide
YTSLIHSLIEESQNQQEKNEQELLELDKWASLWDWF

SEQ ID NO: 732 - protein, 36 aa, Artificial Sequence
  Core polypeptide
LEANITQSLEQAQIQQEKNMYELQKLNSWDVFTNWL

SEQ ID NO: 733 - protein, 36 aa, Artificial Sequence
  Core polypeptide
LEANISASLEQAQIQQEKNMYELQKLNSWDVFTNWL

SEQ ID NO: 734 - protein, 36 aa, Artificial Sequence
  Core polypeptide
LEANISALLEQAQIQQEKNMYELQKLNSWDVFTNWL

SEQ ID NO: 735 - protein, 36 aa, Artificial Sequence
  Core polypeptide
LEANITALLEQAQIQQEKNMYELQKLNSWDVFTNWL

SEQ ID NO: 736 - protein, 36 aa, Artificial Sequence
  Core polypeptide
LEANITASLEQAQIQQEKNMYELQKLNSWDVFTNWL

SEQ ID NO: 737 - protein, 34 aa, Artificial Sequence
  Core polypeptide
RAKFKQLLQHYREVAAAKSSENDRLRLLLKQMPS

SEQ ID NO: 738 - protein, 30 aa, Artificial Sequence
  Core polypeptide
MNSVKNGTYDYPKYEEESKLNRNEIKGVKL

SEQ ID NO: 739 - protein, 36 aa, Artificial Sequence
  Core polypeptide
WQEWEQKVRYLEANISQSLEQAQIQQEKNMYELQKL

SEQ ID NO: 740 - protein, 35 aa, Artificial Sequence
  Core polypeptide
DEYDASISQVNEKINQSLAFIRKSDELLHNVNAGK

SEQ ID NO: 741 - protein, 34 aa, Artificial Sequence
  Core polypeptide
YTSLIHSLIEESQNQQEKNEQELLELDKWASLWN

SEQ ID NO: 742 - protein, 33 aa, Artificial Sequence
  Core polypeptide
YTSLIHSLIEESQNQQEKNEQELLELDKWASLW

SEQ ID NO: 743 - protein, 32 aa, Artificial Sequence
  Core polypeptide
YTSLIHSLIEESQNQQEKNEQELLELDKWASL

SEQ ID NO: 744 - protein, 31 aa, Artificial Sequence
  Core polypeptide
YTSLIHSLIEESQNQQEKNEQELLELDKWAS

SEQ ID NO: 745 - protein, 51 aa, Artificial Sequence
  Core polypeptide
QARQLLSGIVQQQNNLLRAIEAQQHLLQLTVWGIKQLQARILAVERYLKDQ

SEQ ID NO: 746 - protein, 42 aa, Artificial Sequence
  Core polypeptide
DREINNYTSLIHSLIEESQNQQEKNEQELLELDKWASLWNWF

SEQ ID NO: 747 - protein, 42 aa, Artificial Sequence
  Core polypeptide
NNMTWMEWDREINNYTSLIHSLIEESQNQQEKNEQELLELDK

SEQ ID NO: 748 - protein, 36 aa, Artificial Sequence
  Core polypeptide
YTSLIHSLIEESQNQQEKNEQELLELDKWASLWAAA

SEQ ID NO: 749 - protein, 36 aa, Artificial Sequence
  Core polypeptide
YTSLIHSLIEESQNQQEKNEQELLELDKWAAAANWF

SEQ ID NO: 750 - protein, 36 aa, Artificial Sequence
  Core polypeptide
YTSLIHSLIEESQNQQEKNEQELLELDAAASLWNWF

SEQ ID NO: 751 - protein, 36 aa, Artificial Sequence
  Core polypeptide
YTSLIHSLIEESQNQQEKNEQELLAAAKWASLWNWF

SEQ ID NO: 752 - protein, 36 aa, Artificial Sequence
  Core polypeptide
YTSLIHSLIEESQNQQEKNEQAAAELDKWASLWNWF

SEQ ID NO: 753 - protein, 36 aa, Artificial Sequence
  Core polypeptide
YTSLIHSLIEESQNQQEKAAAELLELDKWASLWNWF

SEQ ID NO: 754 - protein, 36 aa, Artificial Sequence
  Core polypeptide
YTSLIHSLIEESQNQAAANEQELLELDKWASLWNWF

SEQ ID NO: 755 - protein, 36 aa, Artificial Sequence
  Core polypeptide
YTSLIHSLIEESAAAQEKNEQELLELDKWASLWNWF

SEQ ID NO: 756 - protein, 36 aa, Artificial Sequence
  Core polypeptide
YTSLIHSLIAAAQNQQEKNEQELLELDKWASLWNWF

SEQ ID NO: 757 - protein, 36 aa, Artificial Sequence
  Core polypeptide
YTSLIHAAAEESQNQQEKNEQELLELDKWASLWNWF

SEQ ID NO: 758 - protein, 36 aa, Artificial Sequence
  Core polypeptide
YTSAAASLIEESQNQQEKNEQELLELDKWASLWNWF

SEQ ID NO: 759 - protein, 35 aa, Artificial Sequence
  Core polypeptide
EIWNNMTWMEWDRENEKINQSLAFIRKSDELLHNV

SEQ ID NO: 760 - protein, 36 aa, Artificial Sequence
  Core polypeptide
YISEVNEEINQSLAFIRKADELLENVDKWASLWNWF

SEQ ID NO: 761 - protein, 35 aa, Artificial Sequence
  Core polypeptide
TSVITIELSNIKENKANGTDAKVKLIKQELDKYKN

SEQ ID NO: 762 - protein, 38 aa, Artificial Sequence
  Core polypeptide
YTSLIHSLIEESQNQQEKNEQELLELDKWASLWNWFMG

SEQ ID NO: 763 - protein, 21 aa, Artificial Sequence
  Core polypeptide
NEKINQSLAFIRKSDELLHNV

SEQ ID NO: 764 - protein, 35 aa, Artificial Sequence; identical to SEQ ID NO: 104
  Core polypeptide

SEQ ID NO: 765 - protein, 35 aa, Artificial Sequence; identical to SEQ ID NO: 106
  Core polypeptide

SEQ ID NO: 766 - protein, 35 aa, Artificial Sequence; identical to SEQ ID NO: 108
  Core polypeptide

SEQ ID NO: 767 - protein, 35 aa, Artificial Sequence; identical to SEQ ID NO: 112
  Core polypeptide

SEQ ID NO: 768 - protein, 35 aa, Artificial Sequence; identical to SEQ ID NO: 718
  Core polypeptide

SEQ ID NO: 769 - protein, 35 aa, Artificial Sequence; identical to SEQ ID NO: 692
  Core polypeptide

SEQ ID NO: 770 - protein, 35 aa, Artificial Sequence
  Core polypeptide
VYPSDEFDASISQVQEEIQQALAFIRKADELLEQV

SEQ ID NO: 771 - protein, 37 aa, Artificial Sequence
  Core polypeptide
NYTSLIHSLIEESQNQQEKNEQELLELDKWASLWNWF

SEQ ID NO: 772 - protein, 38 aa, Artificial Sequence
  Core polypeptide
NNYTSLIHSLIEESQNQQEKNEQELLELDKWASLWNWF

SEQ ID NO: 773 - protein, 39 aa, Artificial Sequence
  Core polypeptide
INNYTSLIHSLIEESQNQQEKNEQELLELDKWASLWNWF

SEQ ID NO: 774 - protein, 40 aa, Artificial Sequence
  Core polypeptide
EINNYTSLIHSLIEESQNQQEKNEQELLELDKWASLWNWF

SEQ ID NO: 775 - protein, 37 aa, Artificial Sequence
  Core polypeptide
YTSLIHSLIEESQNQQEKNEQELLELDKWASLWNWFN

SEQ ID NO: 776 - protein, 38 aa, Artificial Sequence
  Core polypeptide
YTSLIHSLIEESQNQQEKNEQELLELDKWASLWNWFNI

SEQ ID NO: 777 - protein, 39 aa, Artificial Sequence
  Core polypeptide
YTSLIHSLIEESQNQQEKNEQELLELDKWASLWNWFNIT

SEQ ID NO: 778 - protein, 40 aa, Artificial Sequence
  Core polypeptide
YTSLIHSLIEESQNQQEKNEQELLELDKWASLWNWFNITN

SEQ ID NO: 779 - protein, 43 aa, Artificial Sequence
  Core polypeptide
YDPLVFPSDEFDASISQVNEKINQSLAFIRKSDELLHNVNAGK

SEQ ID NO: 780 - protein, 38 aa, Artificial Sequence
  Core polypeptide
NYTSLIHSLIEESQNQQEKNEQELLELDKWASLWNWFN

SEQ ID NO: 781 - protein, 40 aa, Artificial Sequence
  Core polypeptide
NNYTSLIHSLIEESQNQQEKNEQELLELDKWASLWNWFNI

SEQ ID NO: 782 - protein, 49 aa, Artificial Sequence
  Core polypeptide
KCRAKFKQLLQHYREVAAAKSSENDRLRLLLKQMCPSLDVDSIIPRTPD

SEQ ID NO: 783 - protein, 47 aa, Artificial Sequence
  Core polypeptide
RAKFKQLLQHYREVAAAKSSENDRLRLLLKQMCPSLDVDSIIPRTPD

SEQ ID NO: 784 - protein, 35 aa, Artificial Sequence
  Core polypeptide
VYPSDEYDASISQVNEEINQALAYIAAADELLENV

SEQ ID NO: 785 - protein, 26 aa, Artificial Sequence
  Core polypeptide
YDASISQVNEEINQALAYIRKADELL

SEQ ID NO: 786 - protein, 40 aa, Artificial Sequence
  Core polypeptide
MNLEWMEWDREINNYTSLIHSLIEESQNQQEKNEQELLEL

SEQ ID NO: 787 - protein, 34 aa, Artificial Sequence
  Core polypeptide
KNGTYDYPKYEEESKLNRNEIKGVKLSSMGVYQI

SEQ ID NO: 788 - protein, 35 aa, Artificial Sequence
  Core polypeptide
VTEKIQMASDNINDLIQSGVNTRLLTIQSHVQNYI

SEQ ID NO: 789 - protein, 24 aa, Artificial Sequence
  Core polypeptide
QNQQEKNEQELLELDKWASLWNWF

SEQ ID NO: 790 - protein, 24 aa, Artificial Sequence
  Core polypeptide
QNQQEKNEQELLELDKWASLWNWF

SEQ ID NO: 791 - protein, 5 aa, Artificial Sequence
  Core polypeptide
LWNWF

SEQ ID NO: 792 - protein, 15 aa, Artificial Sequence
  Core polypeptide
ELLELDKWASLWNWF

SEQ ID NO: 793 - protein, 20 aa, Artificial Sequence
  Core polypeptide
EKNEQELLELDKWASLWNWF

SEQ ID NO: 794 - protein, 30 aa, Artificial Sequence
  Core polypeptide
SLIEESQNQQEKNEQELLELDKWASLWNWF

SEQ ID NO: 795 - protein, 35 aa, Artificial Sequence
  Core polypeptide
YTSLIHSLIEESQNQQEKNEQELLELDKWASLWNW

SEQ ID NO: 796 - protein, 34 aa, Artificial Sequence; identical to SEQ ID NO: 741
  Core polypeptide

SEQ ID NO: 797 - protein, 33 aa, Artificial Sequence; identical to SEQ ID NO: 742
  Core polypeptide

SEQ ID NO: 798 - protein, 32 aa, Artificial Sequence; identical to SEQ ID NO: 743
  Core polypeptide

SEQ ID NO: 799 - protein, 35 aa, Artificial Sequence; identical to SEQ ID NO: 638
  Core polypeptide

SEQ ID NO: 800 - protein, 34 aa, Artificial Sequence
  Core polypeptide
SLIHSLIEESQNQQEKNEQELLELDKWASLWNWF

SEQ ID NO: 801 - protein, 33 aa, Artificial Sequence; identical to SEQ ID NO: 61
  Core polypeptide

SEQ ID NO: 802 - protein, 32 aa, Artificial Sequence
  Core polypeptide
IHSLIEESQNQQEKNEQELLELDKWASLWNWF

SEQ ID NO: 803 - protein, 51 aa, Artificial Sequence
  Core polypeptide
AAVALLPAVLLALLAPSELEIKRYKNRVASRKCRAKFKQLLQHYREVAAAK

SEQ ID NO: 804 - protein, 51 aa, Artificial Sequence
  Core polypeptide
AAVALLPAVLLALLAPCRAKFKQLLQHYREVAAAKSSENDRLRLLLKQMCP

SEQ ID NO: 805 - protein, 36 aa, Artificial Sequence
  Core polypeptide
YTSLIHSLIEESQNQQEKNNNIERDWEMWTMNNWIQ

SEQ ID NO: 806 - protein, 35 aa, Artificial Sequence; identical to SEQ ID NO: 692
  Core polypeptide

SEQ ID NO: 807 - protein, 35 aa, Artificial Sequence
  Core polypeptide
LMQLARQLMQLARQMKQLADSLMQLARQVSRLESA

SEQ ID NO: 808 - protein, 34 aa, Artificial Sequence
  Core polypeptide
WMEWDREINNYTSLIHSLIEESQNQQEKNEQELL

SEQ ID NO: 809 - protein, 35 aa, Artificial Sequence
  Core polypeptide
MEWDREINNYTSLIHSLIEESQNQQEKNEQELLEL

SEQ ID NO: 810 - protein, 34 aa, Artificial Sequence
  Core polypeptide
EWDREINNYTSLIHSLIEESQNQQEKNEQELLEL

SEQ ID NO: 811 - protein, 34 aa, Artificial Sequence
  Core polypeptide
MEWDREINNYTSLIHSLIEESQNQQEKNEQELLE

SEQ ID NO: 812 - protein, 36 aa, Artificial Sequence
  Core polypeptide
WNEWDREINNYTSLIHSLIEESQNQQEKNEQELLEL

SEQ ID NO: 813 - protein, 36 aa, Artificial Sequence
  Core polypeptide
YLEYDREINNYTSLIHSLIEESQNQQEKNEQELLEL

SEQ ID NO: 814 - protein, 17 aa, Artificial Sequence
  Core polypeptide
IKQFINMWQEVGKAMYA

SEQ ID NO: 815 - protein, 8 aa, Artificial Sequence
  Core polypeptide
IRKSDELL

SEQ ID NO: 816 - protein, 8 aa, Artificial Sequence
  Core polypeptide
YDASISQV

SEQ ID NO: 817 - protein, 8 aa, Artificial Sequence
  Core polypeptide
NEKINQSL

SEQ ID NO: 818 - protein, 23 aa, Artificial Sequence
  Core polypeptide
SISQVNEEINQALAYIRKADELL

SEQ ID NO: 819 - protein, 20 aa, Artificial Sequence
  Core polypeptide
QVNEEINQALAYIRKADELL

SEQ ID NO: 820 - protein, 17 aa, Artificial Sequence
  Core polypeptide
EEINQALAYIRKADELL

SEQ ID NO: 821 - protein, 14 aa, Artificial Sequence
  Core polypeptide
NQALAYIRKADELL

SEQ ID NO: 822 - protein, 11 aa, Artificial Sequence
  Core polypeptide
LAYIRKADELL

SEQ ID NO: 823 - protein, 26 aa, Artificial Sequence
  Core polypeptide
FDASISQVNEKINQALAFIRKSDELL

SEQ ID NO: 824 - protein, 36 aa, Artificial Sequence; identical to SEQ ID NO: 812
  Core polypeptide

SEQ ID NO: 825 - protein, 45 aa, Artificial Sequence
  Core polypeptide
ASRKCRAKFKQLLQHYREVAAAKSSENDRLRLLLKQMCPSLDVDS

SEQ ID NO: 826 - protein, 4 aa, Artificial Sequence
  Core polypeptide
ZFFG

SEQ ID NO: 827 - protein, 36 aa, Artificial Sequence
  Core polypeptide
WLEWDREINNYTSLIHSLIEESQNQQEKNEQELLEL

SEQ ID NO: 828 - protein, 36 aa, Artificial Sequence
  Core polypeptide
YVKGEPIINFYDPLVFPSDEFDASISQVNEKINQSL

SEQ ID NO: 829 - protein, 35 aa, Artificial Sequence
  Core polypeptide
VYPSDEYDASISQVNEEINQSLAYIRKADELLHNV

SEQ ID NO: 830 - protein, 29 aa, Artificial Sequence
  Core polypeptide
YDASISQVNEEINQALAYIRKADELLENV

SEQ ID NO: 831 - protein, 27 aa, Artificial Sequence
  Core polypeptide
YDASISQVNEEINQALAYIRKADELLE

SEQ ID NO: 832 - protein, 35 aa, Artificial Sequence
  Core polypeptide
VYPSDEYDASISQVNEEINQALAYIRKAAELLHNV

SEQ ID NO: 833 - protein, 35 aa, Artificial Sequence
  Core polypeptide
VYPSDEYDASISQVNEEINQALAYIRKALELLHNV

SEQ ID NO: 834 - protein, 36 aa, Artificial Sequence; identical to SEQ ID NO: 15
  Core polypeptide

SEQ ID NO: 835 - protein, 35 aa, Artificial Sequence
  Core polypeptide
VYPSDEYDASISQVNEEINQLLAYIRKLDELLENV

SEQ ID NO: 836 - protein, 28 aa, Artificial Sequence
  Core polypeptide
DEYDASISQVNEKINQSLAFIRKSDELL

SEQ ID NO: 837 - protein, 35 aa, Artificial Sequence
  Core polypeptide
SNDQGSGYAADKESTQKAFDGITNKVNSVIEKTNT

SEQ ID NO: 838 - protein, 38 aa, Artificial Sequence
  Core polypeptide
ESTQKAFDGITNKVNSVIEKTNTQFEAVGKEFGNLEKR

SEQ ID NO: 839 - protein, 37 aa, Artificial Sequence
  Core polypeptide
DGITNKVNSVIEKTNTQFEAVGKEFGNLEKRLENLNK

SEQ ID NO: 840 - protein, 32 aa, Artificial Sequence
  Core polypeptide
DSNVKNLYDKVRSQLRDNVKELGNGAFEFYHK

SEQ ID NO: 841 - protein, 36 aa, Artificial Sequence
  Core polypeptide
RDNVKELGNGAFEFYHKADDEALNSVKNGTYDYPKY

SEQ ID NO: 842 - protein, 24 aa, Artificial Sequence
  Core polypeptide
EFYHKADDEALNSVKNGTYDYPKY

SEQ ID NO: 843 - protein, 36 aa, Artificial Sequence
  Core polypeptide
AAVALLPAVLLALLAPAADKESTQKAFDGITNKVNS

SEQ ID NO: 844 - protein, 36 aa, Artificial Sequence
  Core polypeptide
AAVALLPAVLLALLAPAADSNVKNLYDKVRSQLRDN

SEQ ID NO: 845 - protein, 18 aa, Artificial Sequence
  Core polypeptide
KESTQKAFDGITNKVNSV

SEQ ID NO: 846 - protein, 20 aa, Artificial Sequence
  Core polypeptide
IEKTNTQFEAVGKEFGNLER

SEQ ID NO: 847 - protein, 30 aa, Artificial Sequence
  Core polypeptide
RLENLNKRVEDGFLDVWTYNAELLVALENE

SEQ ID NO: 848 - protein, 17 aa, Artificial Sequence
  Core polypeptide
SNVKNLYDKVRSQLRDN

SEQ ID NO: 849 - protein, 33 aa, Artificial Sequence
  Core polypeptide
WMEWDREINNYTSLIHSLIEESQNQQEKNEQEL

SEQ ID NO: 850 - protein, 32 aa, Artificial Sequence
  Core polypeptide
WMEWDREINNYTSLIHSLIEESQNQQEKNEQE

SEQ ID NO: 851 - protein, 32 aa, Artificial Sequence
  Core polypeptide
MEWDREINNYTSLIHSLIEESQNQQEKNEQEL

SEQ ID NO: 852 - protein, 31 aa, Artificial Sequence
  Core polypeptide
MEWDREINNYTSLIHSLIEESQNQQEKNEQE

SEQ ID NO: 853 - protein, 33 aa, Artificial Sequence
  Core polypeptide
EWDREINNYTSLIHSLIEESQNQQEKNEQELLE

SEQ ID NO: 854 - protein, 32 aa, Artificial Sequence
  Core polypeptide
EWDREINNYTSLIHSLIEESQNQQEKNEQELL

SEQ ID NO: 855 - protein, 31 aa, Artificial Sequence
  Core polypeptide
EWDREINNYTSLIHSLIEESQNQQEKNEQEL

SEQ ID NO: 856 - protein, 36 aa, Artificial Sequence
  Core polypeptide
YTKFIYTLLEESQNQQEKNEQELLELDKWASLWNWF

SEQ ID NO: 857 - protein, 22 aa, Artificial Sequence
  Core polypeptide
YMKQLADSLMQLARQVSRLESA

SEQ ID NO: 858 - protein, 29 aa, Artificial Sequence
  Core polypeptide
YLMQLARQMKQLADSLMQLARQVSRLESA

SEQ ID NO: 859 - protein, 36 aa, Artificial Sequence
  Core polypeptide
YQEWERKVDFLEENITALLEEAQIQQEKNMYELQKL

SEQ ID NO: 860 - protein, 36 aa, Artificial Sequence
  Core polypeptide
WMAWAAAINNYTSLIHSLIEESQNQQEKNEQEEEEE

SEQ ID NO: 861 - protein, 36 aa, Artificial Sequence
  Core polypeptide
YASLIAALIEESQNQQEKNEQELLELAKWAALWAWF

SEQ ID NO: 862 - protein, 38 aa, Artificial Sequence
  Core polypeptide
EWDREINNYTSLIHSLIEESQNQQEKNEQEGGCDIMER

SEQ ID NO: 863 - protein, 35 aa, Artificial Sequence
  Core polypeptide
YDISIELNKAKSDLEESKEWIKKSNQKLDSIGNWH

SEQ ID NO: 864 - protein, 35 aa, Artificial Sequence; identical to SEQ ID NO: 548
  Core polypeptide

SEQ ID NO: 865 - protein, 6 aa, Artificial Sequence
  Core polypeptide
YTSLIH

SEQ ID NO: 866 - protein, 7 aa, Artificial Sequence
  Core polypeptide
HSLIEEH

SEQ ID NO: 867 - protein, 8 aa, Artificial Sequence
  Core polypeptide
SQNQQEKH

SEQ ID NO: 868 - protein, 9 aa, Artificial Sequence
  Core polypeptide
NEQELLELH

SEQ ID NO: 869 - protein, 7 aa, Artificial Sequence
  Core polypeptide
DKWASLH

SEQ ID NO: 870 - protein, 5 aa, Artificial Sequence
  Core polypeptide
WNWFH

SEQ ID NO: 871 - protein, 36 aa, Artificial Sequence
  Core polypeptide
AKTLERTWDTLNHLLFISSALYKLNLKSVAQITLSI

SEQ ID NO: 872 - protein, 24 aa, Artificial Sequence
  Core polypeptide
NITLQAKIKQFINMWQEVGKAMYA

SEQ ID NO: 873 - protein, 28 aa, Artificial Sequence
  Core polypeptide
LENERTLDFHDSNVKNLYDKVRLQLRDN

SEQ ID NO: 874 - protein, 35 aa, Artificial Sequence
  Core polypeptide
LENERTLDFHDSNVKNLYDKVRLQLRDNVKELGNG

SEQ ID NO: 875 - protein, 34 aa, Artificial Sequence
  Core polypeptide
TLDFHDSNVKNLYDKVRLQLRDNVKELGNGAFEF

SEQ ID NO: 876 - protein, 26 aa, Artificial Sequence
  Core polypeptide
FDASISQVNEKINQALAFIRKSDELL

SEQ ID NO: 877 - protein, 23 aa, Artificial Sequence
  Core polypeptide
SISQVNEEINQALAYIRKADELL

SEQ ID NO: 878 - protein, 23 aa, Artificial Sequence
  Core polypeptide
SISQVNEEINQSLAYIRKSDELL

SEQ ID NO: 879 - protein, 23 aa, Artificial Sequence
  Core polypeptide
SISQVNEEINQSLAYIRKSDELL

SEQ ID NO: 880 - protein, 35 aa, Artificial Sequence
  Core polypeptide
NSVALDPIDISIELNKAKSDLEESKEWIKKSNQKL

SEQ ID NO: 881 - protein, 35 aa, Artificial Sequence
  Core polypeptide
ALDPIDISIELNKAKSDLEESKEWIKKSNQKLDSI

SEQ ID NO: 882 - protein, 35 aa, Artificial Sequence; identical to SEQ ID NO: 880
  Core polypeptide

SEQ ID NO: 883 - protein, 35 aa, Artificial Sequence; identical to SEQ ID NO: 881
  Core polypeptide

SEQ ID NO: 884 - protein, 26 aa, Artificial Sequence
  Core polypeptide
YDASISQVNEEINQALAYIRKADELL

SEQ ID NO: 885 - protein, 26 aa, Artificial Sequence
  Core polypeptide
YDASISQVNEEINQSLAFIRKSDELL

SEQ ID NO: 886 - protein, 26 aa, Artificial Sequence
  Core polypeptide
YDASISQVNEEINQSLAFIRKSDELL

SEQ ID NO: 887 - protein, 33 aa, Artificial Sequence
  Core polypeptide
WLEWDREINNYTSLIHSLIEESQNQQEKNEQEL

SEQ ID NO: 888 - protein, 35 aa, Artificial Sequence; identical to SEQ ID NO: 202
  Core polypeptide

SEQ ID NO: 889 - protein, 35 aa, Artificial Sequence; identical to SEQ ID NO: 880
  Core polypeptide

SEQ ID NO: 890 - protein, 26 aa, Artificial Sequence
  Core polypeptide
YDASISQVNEEINQALAYIRKADELL

SEQ ID NO: 891 - protein, 28 aa, Artificial Sequence
  Core polypeptide
DEYDASISQVNEKINQSLAFIRKSDELL

SEQ ID NO: 892 - protein, 33 aa, Artificial Sequence
  Core polypeptide
WQEWEQKVRYLEANISQSLEQAQIQQEKNMYEL

SEQ ID NO: 893 - protein, 33 aa, Artificial Sequence
  Core polypeptide
WQEWEQKVRYLEANISQSLEQAQIQQEKNEYEL

SEQ ID NO: 894 - protein, 33 aa, Artificial Sequence
  Core polypeptide
WQEWEQKVRYLEANITALLEQAQIQQEKNEYEL

SEQ ID NO: 895 - protein, 33 aa, Artificial Sequence
  Core polypeptide
WQEWEQKVRYLEANITALLEQAQIQQEKNMYEL

SEQ ID NO: 896 - protein, 36 aa, Artificial Sequence
  Core polypeptide
WQEWEQKVRYLEANISQSLEQAQIQQEKNEYELQKL

SEQ ID NO: 897 - protein, 36 aa, Artificial Sequence
  Core polypeptide
WQEWEQKVRYLEANITALLEQAQIQQEKNEYELQKL

SEQ ID NO: 898 - protein, 36 aa, Artificial Sequence
  Core polypeptide
WQEWEQKVRYLEANITALLEQAQIQQEKNMYELQKL

SEQ ID NO: 899 - protein, 37 aa, Artificial Sequence
  Core polypeptide
EFGNLEKRLENLNKRVEDGFLDVWTYNAELLVALENE

SEQ ID NO: 900 - protein, 42 aa, Artificial Sequence
  Core polypeptide
EDGFLDVWTYNAELLVLMENERTLDFHDSNVKNLYDKVRMQL

SEQ ID NO: 901 - protein, 23 aa, Artificial Sequence
  Core polypeptide
SISQVNEKINQSLAFIRKSDELL

SEQ ID NO: 902 - protein, 23 aa, Artificial Sequence
  Core polypeptide
SISQVNEKINQSLAFIRKSDELL

SEQ ID NO: 903 - protein, 23 aa, Artificial Sequence
  Core polypeptide
SISQVNEKINQSLAYIRKSDELL

SEQ ID NO: 904 - protein, 38 aa, Artificial Sequence
  Core polypeptide
QQLLDVVKRQQEMLRLTVWGTKNLQARVTAIEKYLKDQ

SEQ ID NO: 905 - protein, 37 aa, Artificial Sequence
  Core polypeptide
YTSLIHSLIEESQNQQEKNEQELLELDKWASLWNWFC

SEQ ID NO: 906 - protein, 26 aa, Artificial Sequence
  Core polypeptide
FDASISQVNEKINQSLAYIRKSDELL

SEQ ID NO: 907 - protein, 30 aa, Artificial Sequence
  Core polypeptide
YTSLIHSLIEESQNQQEKNEQELLELDKWA

SEQ ID NO: 908 - protein, 28 aa, Artificial Sequence
  Core polypeptide
DEFDASISQVNEKINQSLAFIRKSDELL

SEQ ID NO: 909 - protein, 28 aa, Artificial Sequence
  Core polypeptide
DEFDESISQVNEKINQSLAFIRKSDELL

SEQ ID NO: 910 - protein, 28 aa, Artificial Sequence
  Core polypeptide
DEFDESISQVNEKIEQSLAFIRKSDELL

SEQ ID NO: 911 - protein, 28 aa, Artificial Sequence
  Core polypeptide
DEFDESISQVNEKIEESLAFIRKSDELL

SEQ ID NO: 912 - protein, 28 aa, Artificial Sequence
  Core polypeptide
DEFDESISQVNEKIEESLQFIRKSDELL

SEQ ID NO: 913 - protein, 33 aa, Artificial Sequence
  Core polypeptide
GGGGGDEFDASISQVNEKINQSLAFIRKSDELL

SEQ ID NO: 914 - protein, 28 aa, Artificial Sequence
  Core polypeptide
DEFDASISQVNEKINQSLAFIRKSDELL

SEQ ID NO: 915 - protein, 28 aa, Artificial Sequence
  Core polypeptide
DEFDASISQVNEKINQSLAFIRKSDELL

SEQ ID NO: 916 - protein, 35 aa, Artificial Sequence; identical to SEQ ID NO: 198
  Core polypeptide

SEQ ID NO: 917 - protein, 35 aa, Artificial Sequence
  Core polypeptide
YDASISQVNEKINQALAYIRKADELLHNVNAGKST

SEQ ID NO: 918 - protein, 35 aa, Artificial Sequence
  Core polypeptide
VYPSDEYDASISQVNEKINQALAYIRKADELLHNV

SEQ ID NO: 919 - protein, 8 aa, Artificial Sequence
  Core polypeptide
WGWGYGYG

SEQ ID NO: 920 - protein, 9 aa, Artificial Sequence
  Core polypeptide
YGWGWGWGF

SEQ ID NO: 921 - protein, 36 aa, Artificial Sequence
  Core polypeptide
WQEWEQKVRYLEANITALQEQAQIQAEKAEYELQKL

SEQ ID NO: 922 - protein, 36 aa, Artificial Sequence
  Core polypeptide
WQEWEQKVRYLEAEITALQEEAQIQAEKAEYELQKL

SEQ ID NO: 923 - protein, 31 aa, Artificial Sequence; identical to SEQ ID NO: 744
  Core polypeptide

SEQ ID NO: 924 - protein, 35 aa, Artificial Sequence
  Core polypeptide
VWPSDEFDASISQVNEKINQSLAFIRKSDELLHNV

SEQ ID NO: 925 - protein, 35 aa, Artificial Sequence
  Core polypeptide
SKNISEQIDQIKKDEQKEGTGWGLGGKWWTSDWGV

SEQ ID NO: 926 - protein, 35 aa, Artificial Sequence
  Core polypeptide
LSKNISEQIDQIKKDEQKEGTGWGLGGKWWTSDWG

SEQ ID NO: 927 - protein, 35 aa, Artificial Sequence
  Core polypeptide
DLSKNISEQIDQIKKDEQKEGTGWGLGGKWWTSDW

SEQ ID NO: 928 - protein, 35 aa, Artificial Sequence
  Core polypeptide
EDLSKNISEQIDQIKKDEQKEGTGWGLGGKWWTSD

SEQ ID NO: 929 - protein, 35 aa, Artificial Sequence
  Core polypeptide
IEDLSKNISEQIDQIKKDEQKEGTGWGLGGKWWTS

SEQ ID NO: 930 - protein, 35 aa, Artificial Sequence
  Core polypeptide
GIEDLSKNISEQIDQIKKDEQKEGTGWGLGGKWWT

SEQ ID NO: 931 - protein, 35 aa, Artificial Sequence
  Core polypeptide
IGIEDLSKNISEQIDQIKKDEQKEGTGWGLGGKWW

SEQ ID NO: 932 - protein, 34 aa, Artificial Sequence
  Core polypeptide
PSDEFDASISQVNEKINQSLAFIRKSDELLHNVN

SEQ ID NO: 933 - protein, 35 aa, Artificial Sequence
  Core polypeptide
VYPSDEYDASISQVNEKINQALAYIRKADELLENV

SEQ ID NO: 934 - protein, 35 aa, Artificial Sequence
  Core polypeptide
VYPSDEFDASISQVNEKINQALAFIRKADELLENV

SEQ ID NO: 935 - protein, 35 aa, Artificial Sequence
  Core polypeptide
VYPSDEYDASISQVNEKINQALAYIREADELLENV

SEQ ID NO: 936 - protein, 26 aa, Artificial Sequence
  Core polypeptide
YDASISQVNEKINQSLAFIRESDELL

SEQ ID NO: 937 - protein, 35 aa, Artificial Sequence
  Core polypeptide
AIGIEDLSKNISEQIDQIKKDEQKEGTGWGLGGKW

SEQ ID NO: 938 - protein, 35 aa, Artificial Sequence
  Core polypeptide
AAIGIEDLSKNISEQIDQIKKDEQKEGTGWGLGGK

SEQ ID NO: 939 - protein, 35 aa, Artificial Sequence
  Core polypeptide
DAAIGIEDLSKNISEQIDQIKKDEQKEGTGWGLGG

SEQ ID NO: 940 - protein, 35 aa, Artificial Sequence
  Core polypeptide
PDAAIGIEDLSKNISEQIDQIKKDEQKEGTGWGLG

SEQ ID NO: 941 - protein, 35 aa, Artificial Sequence
  Core polypeptide
NITDKIDQIIHDFVDKTLPDQGDNDNWWTGWRQWI

SEQ ID NO: 942 - protein, 35 aa, Artificial Sequence
  Core polypeptide
KNITDKIDQIIHDFVDKTLPDQGDNDNWWTGWRQW

SEQ ID NO: 943 - protein, 35 aa, Artificial Sequence
  Core polypeptide
TKNITDKIDQIIHDFVDKTLPDQGDNDNWWTGWRQ

SEQ ID NO: 944 - protein, 35 aa, Artificial Sequence
  Core polypeptide
WTKNITDKIDQIIHDFVDKTLPDQGDNDNWWTGWR

SEQ ID NO: 945 - protein, 35 aa, Artificial Sequence
  Core polypeptide
DWTKNITDKIDQIIHDFVDKTLPDQGDNDNWWTGW

SEQ ID NO: 946 - protein, 35 aa, Artificial Sequence
  Core polypeptide
HDWTKNITDKIDQIIHDFVDKTLPDQGDNDNWWTG

SEQ ID NO: 947 - protein, 35 aa, Artificial Sequence
  Core polypeptide
PHDWTKNITDKIDQIIHDFVDKTLPDQGDNDNWWT

SEQ ID NO: 948 - protein, 35 aa, Artificial Sequence
  Core polypeptide
EPHDWTKNITDKIDQIIHDFVDKTLPDQGDNDNWW

SEQ ID NO: 949 - protein, 35 aa, Artificial Sequence
  Core polypeptide
IEPHDWTKNITDKIDQIIHDFVDKTLPDQGDNDNW

SEQ ID NO: 950 - protein, 35 aa, Artificial Sequence
  Core polypeptide
AIEPHDWTKNITDKIDQIIHDFVDKTLPDQGDNDN

SEQ ID NO: 951 - protein, 35 aa, Artificial Sequence
  Core polypeptide
AAIEPHDWTKNITDKIDQIIHDFVDKTLPDQGDND

SEQ ID NO: 952 - protein, 35 aa, Artificial Sequence
  Core polypeptide
DAAIEPHDWTKNITDKIDQIIHDFVDKTLPDQGDN

SEQ ID NO: 953 - protein, 35 aa, Artificial Sequence
  Core polypeptide
LSPTVWLSVIWMMWYWGPSLYSILSPFLPLLPIFF

SEQ ID NO: 954 - protein, 45 aa, Artificial Sequence
  Core polypeptide
HNHTTWMEWDREINNYTSLIHSLIEESQNQQEKNEQELLELDKWH

SEQ ID NO: 955 - protein, 53 aa, Artificial Sequence
  Core polypeptide
HQARQLLSGIVQQQNNLLRAIEAQQHLLQLTVWGIKQLQARILAVERYLKDQH

SEQ ID NO: 956 - protein, 35 aa, Artificial Sequence
  Core polypeptide
VYPSDEFDASISQVNEKINQSLAFIREADELLENV

SEQ ID NO: 957 - protein, 35 aa, Artificial Sequence
  Core polypeptide
VFPSDEFDASISQVNEKINQSLAYIREADELLENV

SEQ ID NO: 958 - protein, 28 aa, Artificial Sequence
  Core polypeptide
DEFDASISQVNEKINQSLAYIREADELL

SEQ ID NO: 959 - protein, 50 aa, Artificial Sequence
  Core polypeptide
NEQELLELDKWASLWNWFGGGGDEFDASISQVNEKINQSLAFIRKSDELL

SEQ ID NO: 960 - protein, 45 aa, Artificial Sequence
  Core polypeptide
LELDKWASLWNWFGGGGDEFDASISQVNEKINQSLAFIRKSDELL

SEQ ID NO: 961 - protein, 36 aa, Artificial Sequence
  Core polypeptide
EGEGEGEGDEFDASISQVNEKINQSLAFIRKSDELL

SEQ ID NO: 962 - protein, 43 aa, Artificial Sequence
  Core polypeptide
ASRKCRAKFKQLLQHYREVAAAKSSENDRLRLLLKQMCPSLDV

SEQ ID NO: 963 - protein, 29 aa, Artificial Sequence
  Core polypeptide
GDEEDASISQVNEKINQSLAFIRKSDELL

SEQ ID NO: 964 - protein, 29 aa, Artificial Sequence
  Core polypeptide
GDEEDASESQVNEKINQSLAFIRKSDELL

SEQ ID NO: 965 - protein, 29 aa, Artificial Sequence
  Core polypeptide
GDEEDASESQQNEKINQSLAFIRKSDELL

SEQ ID NO: 966 - protein, 29 aa, Artificial Sequence
  Core polypeptide
GDEEDASESQQNEKQNQSLAFIRKSDELL

SEQ ID NO: 967 - protein, 29 aa, Artificial Sequence
  Core polypeptide
GDEEDASESQQNEKQNQSEAFIRKSDELL

SEQ ID NO: 968 - protein, 30 aa, Artificial Sequence
  Core polypeptide
WGDEFDESISQVNEKIEESLAFIRKSDELL

SEQ ID NO: 969 - protein, 40 aa, Artificial Sequence
  Core polypeptide
YTSLGGDEFDESISQVNEKIEESLAFIRKSDELLGGWNWF

SEQ ID NO: 970 - protein, 48 aa, Artificial Sequence
  Core polypeptide
YTSLIHSLGGDEFDESISQVNEKIEESLAFIRKSDELLGGWASLWNWF

SEQ ID NO: 971 - protein, 29 aa, Artificial Sequence
  Core polypeptide
GDEFDESISQVNEKIEESLAFIRKSDELL

SEQ ID NO: 972 - protein, 29 aa, Artificial Sequence
  Core polypeptide
GDEEDESISQVNEKIEESLAFIRKSDELL

SEQ ID NO: 973 - protein, 29 aa, Artificial Sequence
  Core polypeptide
GDEEDESISQVQEKIEESLAFIRKSDELL

SEQ ID NO: 974 - protein, 29 aa, Artificial Sequence
  Core polypeptide
GDEEDESISQVQEKIEESLLFIRKSDELL

SEQ ID NO: 975 - protein, 29 aa, Artificial Sequence
  Core polypeptide
GDEYDESISQVNEKIEESLAFIRKSDELL

SEQ ID NO: 976 - protein, 29 aa, Artificial Sequence
  Core polypeptide
GDEYDESISQVNEKIEESLAFIRKSDELL

SEQ ID NO: 977 - protein, 36 aa, Artificial Sequence
  Core polypeptide
YTSLIHSLIDEQEKIEELAFIRKSDELLELDKWNWF

SEQ ID NO: 978 - protein, 35 aa, Artificial Sequence; identical to SEQ ID NO: 692
  Core polypeptide

SEQ ID NO: 979 - protein, 38 aa, Artificial Sequence
  Core polypeptide
NNLLRAIEAQQHLLQLTVWGSKQLQARILAVERYLKDQ

SEQ ID NO: 980 - protein, 38 aa, Artificial Sequence
  Core polypeptide
GGGVYPSDEYDASISQVNEEINQALAYIRKADELLENV

SEQ ID NO: 981 - protein, 38 aa, Artificial Sequence
  Core polypeptide
NNLLRAIEAQQHLLQLTVWGEKQLQARILAVERYLKDQ

SEQ ID NO: 982 - protein, 28 aa, Artificial Sequence
  Core polypeptide
PTRVNYILIIGVLVLAEVTGVRADVHLL

SEQ ID NO: 983 - protein, 35 aa, Artificial Sequence
  Core polypeptide
PTRVNYILIIGVLVLAEVTGVRADVHLLEQPGNLW

SEQ ID NO: 984 - protein, 36 aa, Artificial Sequence
  Core polypeptide
PEKTPLLPTRVNYILIIGVLVLABEVTGVRADVHLL

SEQ ID NO: 985 - protein, 38 aa, Artificial Sequence; identical to SEQ ID NO: 980
  Core polypeptide

SEQ ID NO: 986 - protein, 38 aa, Artificial Sequence
  Core polypeptide
YTSLIHSLGGDEFDESISQVNEKIEESLAFIRKSDELL

SEQ ID NO: 987 - protein, 34 aa, Artificial Sequence
  Core polypeptide
YTSLGGDEFDESISQVNEKIEESLAFIRKSDELL

SEQ ID NO: 988 - protein, 38 aa, Artificial Sequence
  Core polypeptide
DEFDESISQVNEKIEESLAFIRKSDELLGGWASLWNWF

SEQ ID NO: 989 - protein, 34 aa, Artificial Sequence
  Core polypeptide
DEFDESISQVNEKIEESLAFIRKSDELLGGWNWF

SEQ ID NO: 990 - protein, 35 aa, Artificial Sequence
  Core polypeptide
YTSLIHSLIEESQNQQEKNEQELLELDKASLWNWF

SEQ ID NO: 991 - protein, 34 aa, Artificial Sequence
  Core polypeptide
YTSLIHSLIEESQNQQEKNEQELLELDKSLWNWF

SEQ ID NO: 992 - protein, 33 aa, Artificial Sequence
  Core polypeptide
YTSLIHSLIEESQNQQEKNEQELLELDKLWNWF

SEQ ID NO: 993 - protein, 32 aa, Artificial Sequence
  Core polypeptide
YTSLIHSLIEESQNQQEKNEQELLELDKWNWF

SEQ ID NO: 994 - protein, 47 aa, Artificial Sequence
  Core polypeptide
MTWMEWDREINNYTSLIHSLIEESQNQQEKNEQELLELDKASLWNWF

SEQ ID NO: 995 - protein, 46 aa, Artificial Sequence
  Core polypeptide
MTWMEWDREINNYTSLIHSLIEESQNQQEKNEQELLELDKSLWNWF

SEQ ID NO: 996 - protein, 45 aa, Artificial Sequence
  Core polypeptide
MTWMEWDREINNYTSLIHSLIEESQNQQEKNEQELLELDKLWNWF

SEQ ID NO: 997 - protein, 44 aa, Artificial Sequence
  Core polypeptide
MTWMEWDREINNYTSLIHSLIEESQNQQEKNEQELLELDKWNWF

SEQ ID NO: 998 - protein, 46 aa, Artificial Sequence
  Core polypeptide
MTWMEWDREINNYTSLIHSLIEESQNQQEKNEQELLELDKWASLWN

SEQ ID NO: 999 - protein, 44 aa, Artificial Sequence
  Core polypeptide
MTWMEWDREINNYTSLIHSLIEESQNQQEKNEQELLELDKWASL

SEQ ID NO: 1000 - protein, 8 aa, Artificial Sequence
  Core polypeptide
HWSYLRPG

SEQ ID NO: 1001 - protein, 36 aa, Artificial Sequence
  Core polypeptide
WNWFDEFDESISQVNEKIEESLAFIRKSDELLWNWF

SEQ ID NO: 1002 - protein, 36 aa, Artificial Sequence
  Core polypeptide
YTSLIHSLIEESQNQQEKNEQELLELDKYASLYNYF

SEQ ID NO: 1003 - protein, 36 aa, Artificial Sequence
  Core polypeptide
YTSLIHSLIEESQNQQEKNEQELLELDKYAYLYNYF

SEQ ID NO: 1004 - protein, 29 aa, Artificial Sequence
  Core polypeptide
DEFDESISQVNEKIEESLAFIRKSDELLW

SEQ ID NO: 1005 - protein, 31 aa, Artificial Sequence
  Core polypeptide
GDEFDESISQVNEKIEESLAFIRKSDELLGW

SEQ ID NO: 1006 - protein, 29 aa, Artificial Sequence
  Core polypeptide
GDEFDESISQVNEKIEESLAFIRESDELL

SEQ ID NO: 1007 - protein, 29 aa, Artificial Sequence
  Core polypeptide
GDEFDESISQVNEKIEESLAFIEESDELL

SEQ ID NO: 1008 - protein, 36 aa, Artificial Sequence
  Core polypeptide
WQEWEQKVNYLEANITALLEQAQIQQEKNEYELQKL

SEQ ID NO: 1009 - protein, 36 aa, Artificial Sequence
  Core polypeptide
WQEWEQKVDYLEANITALLEQAQIQQEKNEYELQKL

SEQ ID NO: 1010 - protein, 36 aa, Artificial Sequence
  Core polypeptide
WQEWEQKVRWLEANITALLEQAQIQQEKNEYELQKL

SEQ ID NO: 1011 - protein, 36 aa, Artificial Sequence
  Core polypeptide
WQEWEKQVRYLEANITALLEQAQIQQEKNEYELQKL

SEQ ID NO: 1012 - protein, 36 aa, Artificial Sequence
  Core polypeptide
WQEWEHQVRYLEANITALLEQAQIQQEKNEYELQKL

SEQ ID NO: 1013 - protein, 36 aa, Artificial Sequence
  Core polypeptide
WQEWEHKVRYLEANITALLEQAQIQQEKNEYELQKL

SEQ ID NO: 1014 - protein, 36 aa, Artificial Sequence
  Core polypeptide
WQEWDREVRYLEANITALLEQAQIQQEKNEYELQKL

SEQ ID NO: 1015 - protein, 36 aa, Artificial Sequence
  Core polypeptide
WQEWEREVRYLEANITALLEQAQIQQEKNEYELQKL

SEQ ID NO: 1016 - protein, 36 aa, Artificial Sequence
  Core polypeptide
WQEWERQVRYLEANITALLEQAQIQQEKNEYELQKL

SEQ ID NO: 1017 - protein, 36 aa, Artificial Sequence
  Core polypeptide
WQEWEQKVKYLEANITALLEQAQIQQEKNEYELQKL

SEQ ID NO: 1018 - protein, 36 aa, Artificial Sequence
  Core polypeptide
WQEWEQKVRFLEANITALLEQAQIQQEKNEYELQKL

SEQ ID NO: 1019 - protein, 35 aa, Artificial Sequence
  Core polypeptide
VNPSDEYDASISQVNEEINQALAYIRKADELLENV

SEQ ID NO: 1020 - protein, 35 aa, Artificial Sequence
  Core polypeptide
VNPSDENDASISQVNEEINQALAYIRKADELLENV

SEQ ID NO: 1021 - protein, 35 aa, Artificial Sequence
  Core polypeptide
VNPSDEYDASISQVNEEINQALANIRKADELLENV

SEQ ID NO: 1022 - protein, 36 aa, Artificial Sequence
  Core polypeptide
VYPSDEFDASISQVNEKINQSLAFIREADELLFNFF

SEQ ID NO: 1023 - protein, 36 aa, Artificial Sequence
  Core polypeptide
VYPSDEYDASISQVNEEINQALAYIRKADELLFNFF

SEQ ID NO: 1024 - protein, 36 aa, Artificial Sequence
  Core polypeptide
YTSLITALLEQAQIQQEKNEYELQKLDKWASLWNWF

SEQ ID NO: 1025 - protein, 36 aa, Artificial Sequence
  Core polypeptide
YTSLITALLEQAQIQQEKNEYELQKLDKWASLWEWF

SEQ ID NO: 1026 - protein, 36 aa, Artificial Sequence
  Core polypeptide
YTSLITALLEQAQIQQEKNEYELQKLDEWASLWEWF

SEQ ID NO: 1027 - protein, 36 aa, Artificial Sequence
  Core polypeptide
YTSLITALLEQAQIQQEKNEYELQELDEWASLWEWF

SEQ ID NO: 1028 - protein, 36 aa, Artificial Sequence
  Core polypeptide
YTSLITALLEEAQIQQEKNEYELQELDEWASLWEWF

SEQ ID NO: 1029 - protein, 28 aa, Artificial Sequence
  Core polypeptide
AAATALLEQAQIQQEKNEYELQKLAAAW

SEQ ID NO: 1030 - protein, 36 aa, Artificial Sequence
  Core polypeptide
WAAWEQKVRYLEANITALLEQAQIQQEKNEYELQKL

SEQ ID NO: 1031 - protein, 36 aa, Artificial Sequence
  Core polypeptide
WQEAAQKVRYLEANITALLEQAQIQQEKNEYELQKL

SEQ ID NO: 1032 - protein, 36 aa, Artificial Sequence
  Core polypeptide
WQEWAAKVRYLEANITALLEQAQIQQEKNEYELQKL

SEQ ID NO: 1033 - protein, 36 aa, Artificial Sequence
  Core polypeptide
WQEWEQKAAYLEANITALLEQAQIQQEKNEYELQKL

SEQ ID NO: 1034 - protein, 36 aa, Artificial Sequence
  Core polypeptide
WQEWEQKVAALEANITALLEQAQIQQEKNEYELQKL

SEQ ID NO: 1035 - protein, 29 aa, Artificial Sequence
  Core polypeptide
GDEFDASISQVNEKINQSLAFIRKSDELT

SEQ ID NO: 1036 - protein, 29 aa, Artificial Sequence
  Core polypeptide
GDEFDASISQVNEKINQSLAFTRKSDELT

SEQ ID NO: 1037 - protein, 29 aa, Artificial Sequence
  Core polypeptide
GDEFDASISQVNEKTNQSLAFTRKSDELT

SEQ ID NO: 1038 - protein, 29 aa, Artificial Sequence
  Core polypeptide
GDEFDASISQTNEKTNQSLAFTRKSDELT

SEQ ID NO: 1039 - protein, 29 aa, Artificial Sequence
  Core polypeptide
GDEFDASTSQTNEKTNQSLAFTRKSDELT

SEQ ID NO: 1040 - protein, 29 aa, Artificial Sequence
  Core polypeptide
GDEYDASTSQTNEKTNQSLAFTRKSDELT

SEQ ID NO: 1041 - protein, 29 aa, Artificial Sequence
  Core polypeptide
GDEFDEEISQVNEKIEESLAFIRKSDELL

SEQ ID NO: 1042 - protein, 29 aa, Artificial Sequence
  Core polypeptide
GDEFDASISQVNEKINQSLAFIRKSDELA

SEQ ID NO: 1043 - protein, 29 aa, Artificial Sequence
  Core polypeptide
GDEFDASASQANEKANQSLAFARKSDELA

SEQ ID NO: 1044 - protein, 29 aa, Artificial Sequence
  Core polypeptide
GDEFDESISQVNEKIEESLAFTRKSDELL

SEQ ID NO: 1045 - protein, 29 aa, Artificial Sequence
  Core polypeptide
GDEFDESISQVNEKTEESLAFIRKSDELL

SEQ ID NO: 1046 - protein, 29 aa, Artificial Sequence
  Core polypeptide
GDEFDESISQTNEKIEESLAFIRKSDELL

SEQ ID NO: 1047 - protein, 29 aa, Artificial Sequence
  Core polypeptide
GDEFDESTSQVNEKIEESLAFIRKSDELL

SEQ ID NO: 1048 - protein, 36 aa, Artificial Sequence
  Core polypeptide
WNWFDEFDESTSQVNEKIEESLAFIRKSDELLWNWF

SEQ ID NO: 1049 - protein, 36 aa, Artificial Sequence
  Core polypeptide
WNWFDEFDESTSQTNEKIEESLAFIRKSDELLWNWF

SEQ ID NO: 1050 - protein, 36 aa, Artificial Sequence
  Core polypeptide
WNWFDEFDESTSQTNEKTEESLAFIRKSDELLWNWF

SEQ ID NO: 1051 - protein, 36 aa, Artificial Sequence
  Core polypeptide
YTNLIYTLLEESQNQQEKNEQELLELDKWASLWSWF

SEQ ID NO: 1052 - protein, 46 aa, Artificial Sequence
  Core polypeptide
WQEWEQKVRYLEANITALLEQAQIQQEKNEYELQKLDKWASLWNWF

SEQ ID NO: 1053 - protein, 50 aa, Artificial Sequence
  Core polypeptide
NNMTWQEWEQKVRYLEANITALLEQAQIQQEKNEYELQKLDKWASLWNWF

SEQ ID NO: 1054 - protein, 16 aa, Artificial Sequence
  Core polypeptide
WNWFIEESDELLWNWF

SEQ ID NO: 1055 - protein, 11 aa, Artificial Sequence
  Core polypeptide
GFIEESDELLW

SEQ ID NO: 1056 - protein, 11 aa, Artificial Sequence
  Core polypeptide
WFIEESDELLW

SEQ ID NO: 1057 - protein, 17 aa, Artificial Sequence
  Core polypeptide
GFNFFIEESDELLFNFF

SEQ ID NO: 1058 - protein, 7 aa, Artificial Sequence
  Core polypeptide
GESDELW

SEQ ID NO: 1059 - protein, 39 aa, Artificial Sequence
  Core polypeptide
WNWFGDEFDESISQVQEEIEESLAFIEESDELLGGWNWF

SEQ ID NO: 1060 - protein, 48 aa, Artificial Sequence
  Core polypeptide
YTSLIHSLGGDEFDESISQVNEEIEESLAFIEESDELLGGWASLWNWF

SEQ ID NO: 1061 - protein, 29 aa, Artificial Sequence
  Core polypeptide
GDEFDESISQVQEEIEESLAFIEESDELL

SEQ ID NO: 1062 - protein, 53 aa, Artificial Sequence
  Core polypeptide
HQARQLLSSIMQQQNNLLRAIEAQQHLLQLTVWGIKQLQARILAVERYLKDQH

SEQ ID NO: 1063 - protein, 25 aa, Artificial Sequence
  Core polypeptide
CPKYVKQNTLKLATGMRNVPEKQTR

SEQ ID NO: 1064 - protein, 30 aa, Artificial Sequence
  Core polypeptide
GLFGAIAGFIENGWEGMIDGWYGFRHQNSC

SEQ ID NO: 1065 - protein, 7 aa, Artificial Sequence
  Core polypeptide
LNFLGGT

SEQ ID NO: 1066 - protein, 14 aa, Artificial Sequence
  Core polypeptide
LDSWWTSLNFLGGT

SEQ ID NO: 1067 - protein, 21 aa, Artificial Sequence
  Core polypeptide
ILTIPQSLDSWWTSLNFLGGT

SEQ ID NO: 1068 - protein, 28 aa, Artificial Sequence
  Core polypeptide
GFFLLTRILTIPQSLDSWWTSLNFLGGT

SEQ ID NO: 1069 - protein, 39 aa, Artificial Sequence
  Core polypeptide
WQEWEQKITALLEQAQIQQEKNEYELQKLDKWASLWNWF

SEQ ID NO: 1070 - protein, 36 aa, Artificial Sequence
  Core polypeptide
WNWFITALLEQAQIQQEKNEYELQKLDKWASLWNWF

SEQ ID NO: 1071 - protein, 39 aa, Artificial Sequence
  Core polypeptide
WQEWEQKITALLEQAQIQQEKNEYELQKLDKWASLWEWF

SEQ ID NO: 1072 - protein, 36 aa, Artificial Sequence
  Core polypeptide
WQEWEQKVRYLEANITALLEQAQIQQEKIEYELQKL

SEQ ID NO: 1073 - protein, 36 aa, Artificial Sequence
  Core polypeptide
WQEWEQKVRYLEAQITALLEQAQIQQEKIEYELQKL

SEQ ID NO: 1074 - protein, 35 aa, Artificial Sequence
  Core polypeptide
KENKANGTDAKVKLIKQELDKYKNAVTELQLLMQS

SEQ ID NO: 1075 - protein, 35 aa, Artificial Sequence
  Core polypeptide
NIKENKANGTDAKVKLIKQELDKYKNAVTELQLLM

SEQ ID NO: 1076 - protein, 36 aa, Artificial Sequence; identical to SEQ ID NO: 15
  Core polypeptide

SEQ ID NO: 1077 - protein, 37 aa, Artificial Sequence
  Core polypeptide
GWNWFDEFDESISQVQEEIEESLAFIEESDELLWNWF

SEQ ID NO: 1078 - protein, 38 aa, Artificial Sequence
  Core polypeptide
WNWFGDEFDESISQVNEKIEESLAFIEESDELLGWNWF

SEQ ID NO: 1079 - protein, 38 aa, Artificial Sequence
  Core polypeptide
WNWFGDEFDESISQVNEKIEESLAFIRKSDELLGWNWF

SEQ ID NO: 1080 - protein, 36 aa, Artificial Sequence; identical to SEQ ID NO: 1001
  Core polypeptide

SEQ ID NO: 1081 - protein, 36 aa, Artificial Sequence
  Core polypeptide
WNWFDEFDESISQVNEKIEESLAFIEESDELLWNWF

SEQ ID NO: 1082 - protein, 21 aa, Artificial Sequence
  Core polypeptide
EESQNQQEKNEQELLELDKWA

SEQ ID NO: 1083 - protein, 21 aa, Artificial Sequence
  Core polypeptide
EESQNQQEKNEQELLELDKWA

SEQ ID NO: 1084 - protein, 36 aa, Artificial Sequence
  Core polypeptide
CGTTDRSGAPTYSWGANDTDVFVLNNTRPPLGNWFG

SEQ ID NO: 1085 - protein, 28 aa, Artificial Sequence
  Core polypeptide
GVEHRLEANWTRGERADLEDRDRSELSP

SEQ ID NO: 1086 - protein, 27 aa, Artificial Sequence
  Core polypeptide
CVREGNASRAWVAVTPTVATRDGKLPT

SEQ ID NO: 1087 - protein, 20 aa, Artificial Sequence
  Core polypeptide
CFSPRHHWTTQDANASIYPG

SEQ ID NO: 1088 - protein, 33 aa, Artificial Sequence
  Core polypeptide
LQHYREVAAAKSSENDRLRLLLKQMCPSLDVDS

SEQ ID NO: 1089 - protein, 46 aa, Artificial Sequence
  Core polypeptide
WQEWDREISNYTSLITALLEQAQIQQEKNEYELQKLDEWASLWEWF

SEQ ID NO: 1090 - protein, 48 aa, Artificial Sequence
  Core polypeptide
CWQEWDREISNYTSLITALLEQAQIQQEKNEYELQKLDEWASLWEWFC

SEQ ID NO: 1091 - protein, 42 aa, Artificial Sequence
  Core polypeptide
WQEWDREISNYTSLITALLEQAQIQQEKNEYELQKLDEWEWF

SEQ ID NO: 1092 - protein, 44 aa, Artificial Sequence
  Core polypeptide
CWQEWDREISNYTSLITALLEQAQIQQEKNEYELQKLDEWEWFC

SEQ ID NO: 1093 - protein, 26 aa, Artificial Sequence
  Core polypeptide
GQNSQSPTSNHSPTSAPPTAPGYRWA

SEQ ID NO: 1094 - protein, 27 aa, Artificial Sequence
  Core polypeptide
PGSSTTSTGPARTALTTAQGTSLYPSA

SEQ ID NO: 1095 - protein, 39 aa, Artificial Sequence
  Core polypeptide
PGSSTTSTGPARTALTTAQGTSLYPSAAATKPSDGNATA

SEQ ID NO: 1096 - protein, 16 aa, Artificial Sequence
  Core polypeptide
QKQEPIDKELYPLTSL

SEQ ID NO: 1097 - protein, 39 aa, Artificial Sequence
  Core polypeptide
WQEWDREITALLEQAQIQQEKNEYELQKLDKWASLWNWF

SEQ ID NO: 1098 - protein, 39 aa, Artificial Sequence
  Core polypeptide
WQEWDREITALLEQAQIQQEKNEYELQKLDEWASLWEWF

SEQ ID NO: 1099 - protein, 35 aa, Artificial Sequence
  Core polypeptide
WQEWDREITALLEQAQIQQEKNEYELQKLDEWEWF

SEQ ID NO: 1100 - protein, 35 aa, Artificial Sequence
  Core polypeptide
WQEWEREITALLEQAQIQQEKIEYELQKLIEWEWF

SEQ ID NO: 1101 - protein, 35 aa, Artificial Sequence
  Core polypeptide
WQEWEREITALLEQAQIQQEKNEYELQKLIEWEWF

SEQ ID NO: 1102 - protein, 35 aa, Artificial Sequence
  Core polypeptide
WQEWEREITALLEQAQIQQEKIEYELQKLDEWEWF

SEQ ID NO: 1103 - protein, 33 aa, Artificial Sequence
  Core polypeptide
WQEWEITALLEQAQIQQEKNEYELQKLDEWEWF

SEQ ID NO: 1104 - protein, 33 aa, Artificial Sequence
  Core polypeptide
WQEWEITALLEQAQIQQEKNEYELQKLIEWEWF

SEQ ID NO: 1105 - protein, 33 aa, Artificial Sequence
  Core polypeptide
WQEWEITALLEQAQIQQEKIEYELQKLDEWEWF

SEQ ID NO: 1106 - protein, 33 aa, Artificial Sequence
  Core polypeptide
WQEWEITALLEQAQIQQEKIEYELQKLIEWEWF

SEQ ID NO: 1107 - protein, 39 aa, Artificial Sequence
  Core polypeptide
WQEWDREIDEYDASISQVNEKINQALAYIREADELWEWF

SEQ ID NO: 1108 - protein, 39 aa, Artificial Sequence
  Core polypeptide
WQEWEREIDEYDASISQVNEKINQALAYIREADELWEWF

SEQ ID NO: 1109 - protein, 37 aa, Artificial Sequence
  Core polypeptide
WQEWEIDEYDASISQVNEKINQALAYIREADELWEWF

SEQ ID NO: 1110 - protein, 39 aa, Artificial Sequence
  Core polypeptide
WQEWDREIDEYDASISQVNEEINQALAYIREADELWEWF

SEQ ID NO: 1111 - protein, 39 aa, Artificial Sequence
  Core polypeptide
WQEWEREIDEYDASISQVNEEINQALAYIREADELWEWF

SEQ ID NO: 1112 - protein, 37 aa, Artificial Sequence
  Core polypeptide
WQEWEIDEYDASISQVNEEINQALAYIREADELWEWF

SEQ ID NO: 1113 - protein, 35 aa, Artificial Sequence
  Core polypeptide
WQEWDEYDASISQVNEKINQALAYIREADELWEWF

SEQ ID NO: 1114 - protein, 35 aa, Artificial Sequence
  Core polypeptide
WQEWDEYDASISQVNEEINQALAYIREADELWEWF

SEQ ID NO: 1115 - protein, 35 aa, Artificial Sequence
  Core polypeptide
WQEWEQKITALLEQAQIQQEKIEYELQKLIEWEWF

SEQ ID NO: 1116 - protein, 39 aa, Artificial Sequence
  Core polypeptide
WQEWEQKITALLEQAQIQQEKIEYELQKLIEWASLWEWF

SEQ ID NO: 1117 - protein, 37 aa, Artificial Sequence
  Core polypeptide
WQEWEITALLEQAQIQQEKIEYELQKLIEWASLWEWF

SEQ ID NO: 1118 - protein, 44 aa, Artificial Sequence
  Core polypeptide
NHTTWMEWDREINNYTSLIHSLIEESQNQQEKNEQELLELDKWH

SEQ ID NO: 1119 - protein, 52 aa, Artificial Sequence
  Core polypeptide
QARQLLSGIVQQQNNLLRAIEAQQHLLQLTVWGIKQLQARILAVERYLKDQH

SEQ ID NO: 1120 - protein, 40 aa, Artificial Sequence
  Core polypeptide
WVYPSDEYDASISQVNEEINQALAYIRKADELLENVWNWF

SEQ ID NO: 1121 - protein, 36 aa, Artificial Sequence; identical to SEQ ID NO: 15
  Core polypeptide

SEQ ID NO: 1122 - protein, 35 aa, Artificial Sequence
  Core polypeptide
WQEWDEYDASISQVNEKINQALAYIREADELWAWF

SEQ ID NO: 1123 - protein, 35 aa, Artificial Sequence
  Core polypeptide
WQAWDEYDASISQVNEKINQALAYIREADELWAWF

SEQ ID NO: 1124 - protein, 35 aa, Artificial Sequence
  Core polypeptide
WQAWDEYDASISQVNEKINQALAYIREADELWEWF

SEQ ID NO: 1125 - protein, 35 aa, Artificial Sequence; identical to SEQ ID NO: 104
  Core polypeptide

SEQ ID NO: 1126 - protein, 28 aa, Artificial Sequence
  Core polypeptide
YDPLVFPSDEFDASISQVNEKINQSLAF

SEQ ID NO: 1127 - protein, 29 aa, Artificial Sequence
  Core polypeptide
QVNEKINQSLAFIRKSDELLHNVNAGKST

SEQ ID NO: 1128 - protein, 8 aa, Artificial Sequence
  Core polypeptide
WMEWDREI

SEQ ID NO: 1129 - protein, 8 aa, Artificial Sequence
  Core polypeptide
WQEWEQKI

SEQ ID NO: 1130 - protein, 39 aa, Artificial Sequence
  Core polypeptide
WQEWEQKITALLEQAQIQQEKIEYELQKLIKWASLWEWF

SEQ ID NO: 1131 - protein, 39 aa, Artificial Sequence; identical to SEQ ID NO: 1116
  Core polypeptide

SEQ ID NO: 1132 - protein, 42 aa, Artificial Sequence
  Core polypeptide
WQEWEREISAYTSLITALLEQAQIQQEKIEYELQKLIEWEWF

SEQ ID NO: 1133 - protein, 40 aa, Artificial Sequence
  Core polypeptide
WQEWEREISAYTSLITALLEQAQIQQEKIEYELQKEWEWF

SEQ ID NO: 1134 - protein, 39 aa, Artificial Sequence
  Core polypeptide
WQEWEREISAYTSLITALLEQAQIQQEKIEYELQKEWEW

SEQ ID NO: 1135 - protein, 41 aa, Artificial Sequence
  Core polypeptide
WQEWEREISAYTSLITALLEQAQIQQEKIEYELQKLIEWEW

SEQ ID NO: 1136 - protein, 36 aa, Artificial Sequence
  Core polypeptide
FNLSDHSESIQKKFQLMKKHVNKIGVDSDPIGSWLR

SEQ ID NO: 1137 - protein, 35 aa, Artificial Sequence
  Core polypeptide
DHSESIQKKFQLMKKHVNKIGVDSDPIGSWLRGIF

SEQ ID NO: 1138 - protein, 40 aa, Artificial Sequence
  Core polypeptide
WSVKQANLTTSLLGDLLDDVTSIRHAVLQNRAWMEWDREI

SEQ ID NO: 1139 - protein, 18 aa, Artificial Sequence
  Core polypeptide
NNMTWMEWDREINNYTSL

SEQ ID NO: 1140 - protein, 36 aa, Artificial Sequence
  Core polypeptide
GAASLTLTVQARQLLSGIVQQQNNLLRAIEAQQHLL

SEQ ID NO: 1141 - protein, 36 aa, Artificial Sequence
  Core polypeptide
ASLTLTVQARQLLSGIVQQQNNLLRAIEAQQHLLQL

SEQ ID NO: 1142 - protein, 34 aa, Artificial Sequence
  Core polypeptide
VSVGNTLYYVNKQEGKSLYVKGEPIINFYDPLVF

SEQ ID NO: 1143 - protein, 10 aa, Artificial Sequence
  Core polypeptide
QHWSYGLRPG

SEQ ID NO: 1144 - protein, 26 aa, Artificial Sequence
  Core polypeptide
WQEWEQKIQHWSYGLRPGWASLWEWF

SEQ ID NO: 1145 - protein, 22 aa, Artificial Sequence
  Core polypeptide
WQEWEQKIQHWSYGLRPGWEWF

SEQ ID NO: 1146 - protein, 18 aa, Artificial Sequence
  Core polypeptide
WNWFQHWSYGLRPGWNWF

SEQ ID NO: 1147 - protein, 18 aa, Artificial Sequence
  Core polypeptide
FNFFQHWSYGLRPGFNFF

SEQ ID NO: 1148 - protein, 18 aa, Artificial Sequence
  Core polypeptide
GAGAQHWSYGLRPGAGAG

SEQ ID NO: 1149 - protein, 39 aa, Artificial Sequence
  Core polypeptide
WQEWEQKITALLEQAQIQQEKIEYELQKLAKWASLWEWF

SEQ ID NO: 1150 - protein, 39 aa, Artificial Sequence
  Core polypeptide
WQEWEQKITALLEQAQIQQEKIEYELQKLAEWASLWEWF

SEQ ID NO: 1151 - protein, 39 aa, Artificial Sequence
  Core polypeptide
WQEWEQKITALLEQAQIQQEKAEYELQKLAEWASLWEWF

SEQ ID NO: 1152 - protein, 39 aa, Artificial Sequence
  Core polypeptide
WQEWEQKITALLEQAQIQQEKAEYELQKLAEWASLWAWF

SEQ ID NO: 1153 - protein, 39 aa, Artificial Sequence
  Core polypeptide
WQEWEQKITALLEQAQIQQEKAEYELQKLAKWASLWAWF

SEQ ID NO: 1154 - protein, 36 aa, Artificial Sequence
  Core polypeptide
TNKAVVSLSNGVSVLTSKVLDLKNYIDKQLLPIVNK

SEQ ID NO: 1155 - protein, 36 aa, Artificial Sequence
  Core polypeptide
KAVVSLSNGVSVLTSKVLDLKNYIDKQLLPIVNKQS

SEQ ID NO: 1156 - protein, 35 aa, Artificial Sequence
  Core polypeptide
WQEWEQKITALLEQAQIQQEKNEYELQKLIEWEWF

SEQ ID NO: 1157 - protein, 35 aa, Artificial Sequence
  Core polypeptide
WQEWEQKITALLEQAQIQQEKGEYELQKLIEWEWF

SEQ ID NO: 1158 - protein, 35 aa, Artificial Sequence
  Core polypeptide
WQEWEQKITALLEQAQIQQEKIEYELQKLDKWEWF

SEQ ID NO: 1159 - protein, 28 aa, Artificial Sequence
  Core polypeptide
YDPLVFPSDEFDASISQVNEKINQSLAF

SEQ ID NO: 1160 - protein, 35 aa, Artificial Sequence; identical to SEQ ID NO: 692
  Core polypeptide

SEQ ID NO: 1161 - protein, 36 aa, Artificial Sequence; identical to SEQ ID NO: 15
  Core polypeptide

SEQ ID NO: 1162 - protein, 36 aa, Artificial Sequence
  Core polypeptide
SGIVQQQNNLLRAIEAQQHLLQLTVWGIKQLQARIL

SEQ ID NO: 1163 - protein, 41 aa, Artificial Sequence
  Core polypeptide
QQQNNLLRAIEAQQHLLQLTVWGIKQLQARILAVERYLKDQ

SEQ ID NO: 1164 - protein, 45 aa, Artificial Sequence
  Core polypeptide
SGIVQQQNNLLRAIEAQQHLLQLTVWGIKQLQARILAVERYLKDQ

SEQ ID NO: 1165 - protein, 39 aa, Artificial Sequence
  Core polypeptide
WQEWEQKITALLEQAQIQQEKNEYELQKLAEWASLWAWF

SEQ ID NO: 1166 - protein, 38 aa, Artificial Sequence
  Core polypeptide
WQEWEQKITALLEQAQIQQEKNEYELQKLAEWASLWAW

SEQ ID NO: 1167 - protein, 38 aa, Artificial Sequence
  Core polypeptide
WQEWEQKITALLEQAQIQQEKAEYELQKLAEWASLWAW

SEQ ID NO: 1168 - protein, 39 aa, Artificial Sequence
  Core polypeptide
WQEWEQKITALLEQAQIQQEKNEYELQKLAEWAGLWAWF

SEQ ID NO: 1169 - protein, 38 aa, Artificial Sequence
  Core polypeptide
WQEWEQKITALLEQAQIQQEKNEYELQKLAEWAGLWAW

SEQ ID NO: 1170 - protein, 38 aa, Artificial Sequence
  Core polypeptide
WQEWEQKITALLEQAQIQQEKAEYELQKLAEWAGLWAW

SEQ ID NO: 1171 - protein, 39 aa, Artificial Sequence
  Core polypeptide
WQEWEQKITALLEQAQIQQEKNEYELQKLDKWAGLWEWF

SEQ ID NO: 1172 - protein, 18 aa, Artificial Sequence
  Core polypeptide
WQEWQHWSYGLRPGWEWF

SEQ ID NO: 1173 - protein, 18 aa, Artificial Sequence
  Core polypeptide
WQAWQHWSYGLRPGWAWF

SEQ ID NO: 1174 - protein, 39 aa, Artificial Sequence; identical to SEQ ID NO: 1071
  Core polypeptide

SEQ ID NO: 1175 - protein, 39 aa, Artificial Sequence; identical to SEQ ID NO: 1071
  Core polypeptide

SEQ ID NO: 1176 - protein, 35 aa, Artificial Sequence; identical to SEQ ID NO: 1115
  Core polypeptide

SEQ ID NO: 1177 - protein, 34 aa, Artificial Sequence
  Core polypeptide
WQEWEQKIALLEQAQIQQEKIEYELQKLIEWEWF

SEQ ID NO: 1178 - protein, 38 aa, Artificial Sequence
  Core polypeptide
WQEWEQKIALLEQAQIQQEKNEYELQKLDKWASLWEWF

SEQ ID NO: 1179 - protein, 38 aa, Artificial Sequence
  Core polypeptide
AGSTMGARSMTLTVQARQLLSGIVQQQNNLLRAIEAQQ

SEQ ID NO: 1180 - protein, 38 aa, Artificial Sequence
  Core polypeptide
AGSAMGAASLTLSAQSRTLLAGIVQQQQQLLDVVKRQQ

SEQ ID NO: 1181 - protein, 38 aa, Artificial Sequence
  Core polypeptide
AGSAMGAASTALTAQSRTLLAGIVQQQQQLLDVVKRQQ

SEQ ID NO: 1182 - protein, 38 aa, Artificial Sequence
  Core polypeptide
ALTAQSRTLLAGIVQQQQQLLDVVKRQQELLRLTVWGT

SEQ ID NO: 1183 - protein, 38 aa, Artificial Sequence
  Core polypeptide
TLSAQSRTLLAGIVQQQQQLLDVVKRQQEMLRLTVWGT

SEQ ID NO: 1184 - protein, 38 aa, Artificial Sequence
  Core polypeptide
TLTVQARQLLSGIVQQQNNLLRAIEAQQHLLQLTVWGI

SEQ ID NO: 1185 - protein, 35 aa, Artificial Sequence
  Core polypeptide
WQAWIEYEAELSQVKEKIEQSLAYIREADELWAWF

SEQ ID NO: 1186 - protein, 35 aa, Artificial Sequence
  Core polypeptide
WQAWIEYEASLSQAKEKIEESKAYIREADELWAWF

SEQ ID NO: 1187 - protein, 35 aa, Artificial Sequence
  Core polypeptide
WQAWIEYERLLVQAKLKIAIAKLYIAKELLEWAWF

SEQ ID NO: 1188 - protein, 35 aa, Artificial Sequence
  Core polypeptide
WQAWIEYERLLVQVKLKIAIALLYIAKELLEWAWF

SEQ ID NO: 1189 - protein, 35 aa, Artificial Sequence
  Core polypeptide
WQAWIELERLLVQVKLKLAIAKLEIAKELLEWAWF

SEQ ID NO: 1190 - protein, 19 aa, Artificial Sequence
  Core polypeptide
GEWTYDDATKTFTVTEGGH

SEQ ID NO: 1191 - protein, 35 aa, Artificial Sequence
  Core polypeptide
WQEWEQKIGEWTYDDATKTFTVTEGGHWASLWEWF

SEQ ID NO: 1192 - protein, 16 aa, Artificial Sequence
  Core polypeptide
GEWTYDDATKTFTVTE

SEQ ID NO: 1193 - protein, 32 aa, Artificial Sequence
  Core polypeptide
WQEWEQKIGEWTYDDATKTFTVTEWASLWEWF

SEQ ID NO: 1194 - protein, 8 aa, Artificial Sequence
  Core polypeptide
MHRFDYRT

SEQ ID NO: 1195 - protein, 24 aa, Artificial Sequence
  Core polypeptide
WQEWEQKIMHRFDYRTWASLWEWF

SEQ ID NO: 1196 - protein, 11 aa, Artificial Sequence
  Core polypeptide
MHRFNWSTGGG

SEQ ID NO: 1197 - protein, 27 aa, Artificial Sequence
  Core polypeptide
WQEWEQKIMHRFNWSTGGGWASLWEWF

SEQ ID NO: 1198 - protein, 8 aa, Artificial Sequence
  Core polypeptide
MHRFNWST

SEQ ID NO: 1199 - protein, 24 aa, Artificial Sequence
  Core polypeptide
WQEWEQKIMHRFNWSTWASLWEWF

SEQ ID NO: 1200 - protein, 18 aa, Artificial Sequence
  Core polypeptide
LLVPLARIMTMSSVHGGG

SEQ ID NO: 1201 - protein, 34 aa, Artificial Sequence
  Core polypeptide
WQEWEQKILLVPLARIMTMSSVHGGGWASLWEWF

SEQ ID NO: 1202 - protein, 15 aa, Artificial Sequence
  Core polypeptide
LLVPLARIMTMSSVH

SEQ ID NO: 1203 - protein, 31 aa, Artificial Sequence
  Core polypeptide
WQEWEQKILLVPLARIMTMSSVHWASLWEWF

SEQ ID NO: 1204 - protein, 23 aa, Artificial Sequence
  Core polypeptide
TALLEQAQIQQEKNEYELQKLDK

SEQ ID NO: 1205 - protein, 23 aa, Artificial Sequence
  Core polypeptide
TALLEQAQIQQEKNEYELQKLDK

SEQ ID NO: 1206 - protein, 23 aa, Artificial Sequence
  Core polypeptide
TALLEQAQIQQEKIEYELQKLIE

SEQ ID NO: 1207 - protein, 23 aa, Artificial Sequence
  Core polypeptide
TALLEQAQIQQEKIEYELQKLIE

SEQ ID NO: 1208 - protein, 47 aa, Artificial Sequence
  Core polypeptide
QARQLLSGIVQQQNNLLRAIEAQQHLLQLTVWGIKQLQARILAVERY

SEQ ID NO: 1209 - protein, 47 aa, Artificial Sequence; identical to SEQ ID NO: 1208
  Core polypeptide

SEQ ID NO: 1210 - protein, 36 aa, Artificial Sequence
  Core polypeptide
GAASLTLSAQSRTLLAGIVQQQQQLLDVVKRQQEML

SEQ ID NO: 1211 - protein, 40 aa, Artificial Sequence
  Core polypeptide
GSAMGAASLTLSAQSRTLLAGIVQQQQQLLDVVKRQQEML

SEQ ID NO: 1212 - protein, 36 aa, Artificial Sequence
  Core polypeptide
PALSTGLIHLHQNIVDVQFLFGVGSSIASWAIKWEY

SEQ ID NO: 1213 - protein, 33 aa, Artificial Sequence
  Core polypeptide
PALSTGLIHLHQNIVDVQFLYGVGSSIASWAIK

SEQ ID NO: 1214 - protein, 34 aa, Artificial Sequence
  Core polypeptide
LSTTQWQVLPSFTTLPALSTGLIHLHQNIVDVQY

SEQ ID NO: 1215 - protein, 31 aa, Artificial Sequence
  Core polypeptide
FRKFPEATFSRGSGPRITPRMVDFPFRLWHY

SEQ ID NO: 1216 - protein, 37 aa, Artificial Sequence
  Core polypeptide
DFPFRLWHFPTINYTIFKVRLFVGGVEHRLEAANWTR

SEQ ID NO: 1217 - protein, 32 aa, Artificial Sequence
  Core polypeptide
YVGGVEHRLEAANWTRGERDLEDRDRSELSPL

SEQ ID NO: 1218 - protein, 36 aa, Artificial Sequence
  Core polypeptide
MVYPSDEYDASISQVNEEINQALAYIRKADELLENV

SEQ ID NO: 1219 - protein, 36 aa, Artificial Sequence; identical to SEQ ID NO: 1218
  Core polypeptide

SEQ ID NO: 1220 - protein, 35 aa, Artificial Sequence
  Core polypeptide
GPLLVLQAGFFLLTRILTIPQSLDSWWTSLNFLGG

SEQ ID NO: 1221 - protein, 35 aa, Artificial Sequence
  Core polypeptide
LGPLLVLQAGFFLLTRILTIPQSLDSWWTSLNFLG

SEQ ID NO: 1222 - protein, 35 aa, Artificial Sequence
  Core polypeptide
FLGPLLVLQAGFFLLTRILTIPQSLDSWWTSLNFL

SEQ ID NO: 1223 - protein, 36 aa, Artificial Sequence
  Core polypeptide
YTSLIGSLIEESQIQQERNEQELLELDRWASLWEWF

SEQ ID NO: 1224 - protein, 34 aa, Artificial Sequence
  Core polypeptide
VYPSDEYDASISQVNEEINQALAYIRKADELLEH

SEQ ID NO: 1225 - protein, 33 aa, Artificial Sequence
  Core polypeptide
VYPSDEYDASISQVNEEINQALAYIRKADELLH

SEQ ID NO: 1226 - protein, 32 aa, Artificial Sequence
  Core polypeptide
VYPSDEYDASISQVNEEINQALAYIRKADELH

SEQ ID NO: 1227 - protein, 34 aa, Artificial Sequence
  Core polypeptide
YPSDEYDASISQVNEEINQALAYIRKADELLENV

SEQ ID NO: 1228 - protein, 33 aa, Artificial Sequence
  Core polypeptide
PSDEYDASISQVNEEINQALAYIRKADELLENV

SEQ ID NO: 1229 - protein, 32 aa, Artificial Sequence
  Core polypeptide
SDEYDASISQVNEEINQALAYIRKADELLENV

SEQ ID NO: 1230 - protein, 31 aa, Artificial Sequence
  Core polypeptide
DEYDASISQVNEEINQALAYIRKADELLENV

SEQ ID NO: 1231 - protein, 35 aa, Artificial Sequence
  Core polypeptide
VYPSDEYDASISQVDEEINQALAYIRKADELLENV

SEQ ID NO: 1232 - protein, 35 aa, Artificial Sequence
  Core polypeptide
VYPSDEYDASISQVNEEIDQALAYIRKADELLENV

SEQ ID NO: 1233 - protein, 35 aa, Artificial Sequence
  Core polypeptide
VYPSDEYDASISQVNEEINQALAYIRKADELLEDV

SEQ ID NO: 1234 - protein, 35 aa, Artificial Sequence
  Core polypeptide
VYPSDEYDASISQVDEEIDQALAYIRKADELLENV

SEQ ID NO: 1235 - protein, 35 aa, Artificial Sequence
  Core polypeptide
LLSTNKAVVSLSNGVSVLTSKVLDLKNYIDKQLLP

SEQ ID NO: 1236 - protein, 35 aa, Artificial Sequence
  Core polypeptide
LSTNKAVVSLSNGVSVLTSKVLDLKNYIDKQLLPI

SEQ ID NO: 1237 - protein, 35 aa, Artificial Sequence; identical to SEQ ID NO: 692
  Core polypeptide

SEQ ID NO: 1238 - protein, 27 aa, Artificial Sequence
  Core polypeptide
DEYDASISQVNEEINQALAYIREADEL

SEQ ID NO: 1239 - protein, 27 aa, Artificial Sequence
  Core polypeptide
DEYDASISQVNEKINQALAYIREADEL

SEQ ID NO: 1240 - protein, 35 aa, Artificial Sequence
  Core polypeptide
DDECLNSVKNGTYDFPKFEEESKLNRNEIKGVKLS

SEQ ID NO: 1241 - protein, 36 aa, Artificial Sequence
  Core polypeptide
DDEABLNSVKNGTYDFPKFEEESKLNRNEIKGVKLS

SEQ ID NO: 1242 - protein, 40 aa, Artificial Sequence
  Core polypeptide
YHKCDDECLNSVKNGTFDFPKFEEESKLNRNEIKGVKLSS

SEQ ID NO: 1243 - protein, 42 aa, Artificial Sequence
  Core polypeptide
YHKABDDEABLNSVKNGTFDFPKFEEESKLNRNEIKGVKLSS

SEQ ID NO: 1244 - protein, 36 aa, Artificial Sequence
  Core polypeptide
YTSLIHSLIEESQIQQEKNEYELQKLDKWASLWNWF

SEQ ID NO: 1245 - protein, 36 aa, Artificial Sequence
  Core polypeptide
YTSLIHSLIEESQNQQEKNEQELQKLDKWASLWNWF

SEQ ID NO: 1246 - protein, 36 aa, Artificial Sequence
  Core polypeptide
YTSLIHSLIEESQNQQEKNEYELQKLDKWASLWNWF

SEQ ID NO: 1247 - protein, 36 aa, Artificial Sequence
  Core polypeptide
YTSLIHSLIEESQIQQEKNEQELQKLDKWASLWNWF

SEQ ID NO: 1248 - protein, 36 aa, Artificial Sequence
  Core polypeptide
YTSLIHSLIEESQNQQEKNEQELLELDKWASLWEWF

SEQ ID NO: 1249 - protein, 36 aa, Artificial Sequence
  Core polypeptide
YTSLIHSLIEESQIQQEKNEQELLELDKWASLWEWF

SEQ ID NO: 1250 - protein, 36 aa, Artificial Sequence
  Core polypeptide
YTSLIHSLIEESQNQQEKNEYELLELDKWASLWEWF

SEQ ID NO: 1251 - protein, 36 aa, Artificial Sequence
  Core polypeptide
YTSLIHSLIEESQIQQEKNEYELLELDKWASLWEWF

SEQ ID NO: 1252 - protein, 36 aa, Artificial Sequence
  Core polypeptide
YTSLIHSLIEESQIQQEKNEYELQKLDKWASLWEWF

SEQ ID NO: 1253 - protein, 36 aa, Artificial Sequence
  Core polypeptide
YTSLIHSLIEESQNQQEKNEQELQKLDKWASLWEWF

SEQ ID NO: 1254 - protein, 36 aa, Artificial Sequence
  Core polypeptide
YTSLIHSLIEESQNQQEKNEYELQKLDKWASLWEWF

SEQ ID NO: 1255 - protein, 36 aa, Artificial Sequence
  Core polypeptide
YTSLIHSLIEESQIQQEKNEQELQKLDKWASLWEWF

SEQ ID NO: 1256 - protein, 39 aa, Artificial Sequence
  Core polypeptide
WQEWEQKITALLEQAQIQQEKNEYELQKLAKWASLWEWF

SEQ ID NO: 1257 - protein, 39 aa, Artificial Sequence
  Core polypeptide
WQEWEQKITALLEQAQIQQEKNEYELQKLIKWASLWEWF

SEQ ID NO: 1258 - protein, 39 aa, Artificial Sequence
  Core polypeptide
WQEWEQKITALLEQAQIQQEKNEYELQKLIEWAGLWEWF

SEQ ID NO: 1259 - protein, 39 aa, Artificial Sequence
  Core polypeptide
WQEWEQKITALLEQAQIQQEKNEYELQKLIKWAGLWEWF

SEQ ID NO: 1260 - protein, 39 aa, Artificial Sequence
  Core polypeptide
WQEWEQKITALLEQAQIQQEKNEYELQKLAKWAGLWEWF

SEQ ID NO: 1261 - protein, 39 aa, Artificial Sequence
  Core polypeptide
WQEWEQKITALLEQAQIQQEKNEYELQKLIEWAGLWAWF

SEQ ID NO: 1262 - protein, 39 aa, Artificial Sequence
  Core polypeptide
WQEWEQKITALLEQAQIQQEKNEYELQKLAKWAGLWAWF

SEQ ID NO: 1263 - protein, 39 aa, Artificial Sequence
  Core polypeptide
WQEWEQKITALLEQAQIQQEKNEYELQKLIKWAGLWAWF

SEQ ID NO: 1264 - protein, 35 aa, Artificial Sequence
  Core polypeptide
WQEWEQKITALLEQAQIQQEKGEYELQKLDKWEWF

SEQ ID NO: 1265 - protein, 35 aa, Artificial Sequence
  Core polypeptide
WQEWEQKITALLEQAQIQQEKGEYELLELDKWEWF

SEQ ID NO: 1266 - protein, 35 aa, Artificial Sequence
  Core polypeptide
WQEWEQKITALLEQAQIQQEKGEYELQKLAKWEWF

SEQ ID NO: 1267 - protein, 35 aa, Artificial Sequence
  Core polypeptide
WQEWEQKITALLEQAQIQQEKGEYELQKLDEWEWF

SEQ ID NO: 1268 - protein, 35 aa, Artificial Sequence
  Core polypeptide
WQEWEQKITALLEQAQIQQEKGEYELLELAKWEWF

SEQ ID NO: 1269 - protein, 35 aa, Artificial Sequence
  Core polypeptide
WQEWEQKITALLEQAQIQQEKNEYELLELDKWEWF

SEQ ID NO: 1270 - protein, 39 aa, Artificial Sequence
  Core polypeptide
WQEWEQKITALLEQAQIQQEKNEYELLELIEWASLWEWF

SEQ ID NO: 1271 - protein, 39 aa, Artificial Sequence
  Core polypeptide
WQEWEQKITALLEQAQIQQEKNEYELLELIEWAGLWEWF

SEQ ID NO: 1272 - protein, 39 aa, Artificial Sequence
  Core polypeptide
WQEWEQKITALLEQAQIQQEKNEYELLELIEWAGLWAWF

SEQ ID NO: 1273 - protein, 39 aa, Artificial Sequence
  Core polypeptide
WQEWEREITALLEQAQIQQEKNEYELQKLIEWASLWEWF

SEQ ID NO: 1274 - protein, 30 aa, Artificial Sequence
  Core polypeptide
WQEWEREIQQEKNEYELQKLDKWASLWEWF

SEQ ID NO: 1275 - protein, 25 aa, Artificial Sequence
  Core polypeptide
WQEWEREIQQEKGEYELQKLEWEWF

SEQ ID NO: 1276 - protein, 29 aa, Artificial Sequence
  Core polypeptide
WQEWQAQIQQEKNEYELQKLDWASLWEWF

SEQ ID NO: 1277 - protein, 26 aa, Artificial Sequence
  Core polypeptide
WQEWQAQIQQEKGEYELQKLIEWEWF

SEQ ID NO: 1278 - protein, 28 aa, Artificial Sequence
  Core polypeptide
YTSLIHSLIEESQNQQEKNEQELLELDK

SEQ ID NO: 1279 - protein, 28 aa, Artificial Sequence
  Core polypeptide
LEENITALLEEAQIQQEKNMYELQKLNS

SEQ ID NO: 1280 - protein, 28 aa, Artificial Sequence
  Core polypeptide
LEANISQSLEQAQIQQEKNMYELQKLNS

SEQ ID NO: 1281 - protein, 28 aa, Artificial Sequence
  Core polypeptide
NNYTSLIHSLIEESQNQQEKNEQELLEL

SEQ ID NO: 1282 - protein, 28 aa, Artificial Sequence
  Core polypeptide
DFLEENITALLEEAQIQQEKNMYELQKL

SEQ ID NO: 1283 - protein, 28 aa, Artificial Sequence
  Core polypeptide
RYLEANISQSLEQAQIQQEKNMYELQKL

SEQ ID NO: 1284 - protein, 28 aa, Artificial Sequence
  Core polypeptide
RYLEANITALLEQAQIQQEKNEYELQKL

SEQ ID NO: 1285 - protein, 30 aa, Artificial Sequence
  Core polypeptide
NNYTSLIHSLIEESQNQQEKNEQELLELDK

SEQ ID NO: 1286 - protein, 23 aa, Artificial Sequence
  Core polypeptide
TALLEQAQIQQEKNEYELQKLDK

SEQ ID NO: 1287 - protein, 23 aa, Artificial Sequence
  Core polypeptide
TALLEQAQIQQEKNEYELQKLDE

SEQ ID NO: 1288 - protein, 23 aa, Artificial Sequence
  Core polypeptide
TALLEQAQIQQEKNEYELQKLIE

SEQ ID NO: 1289 - protein, 23 aa, Artificial Sequence
  Core polypeptide
TALLEQAQIQQEKIEYELQKLDK

SEQ ID NO: 1290 - protein, 23 aa, Artificial Sequence
  Core polypeptide
TALLEQAQIQQEKIEYELQKLDE

SEQ ID NO: 1291 - protein, 23 aa, Artificial Sequence
  Core polypeptide
TALLEQAQIQQEKIEYELQKLIE

SEQ ID NO: 1292 - protein, 22 aa, Artificial Sequence
  Core polypeptide
TALLEQAQIQQEKIEYELQKLE

SEQ ID NO: 1293 - protein, 23 aa, Artificial Sequence
  Core polypeptide
TALLEQAQIQQEKIEYELQKLAK

SEQ ID NO: 1294 - protein, 23 aa, Artificial Sequence
  Core polypeptide
TALLEQAQIQQEKIEYELQKLAE

SEQ ID NO: 1295 - protein, 22 aa, Artificial Sequence
  Core polypeptide
TALLEQAQIQQEKAEYELQKLE

SEQ ID NO: 1296 - protein, 22 aa, Artificial Sequence
  Core polypeptide
TALLEQAQIQQEKNEYELQKLE

SEQ ID NO: 1297 - protein, 22 aa, Artificial Sequence
  Core polypeptide
TALLEQAQIQQEKGEYELQKLE

SEQ ID NO: 1298 - protein, 23 aa, Artificial Sequence
  Core polypeptide
TALLEQAQIQQEKAEYELQKLAK

SEQ ID NO: 1299 - protein, 23 aa, Artificial Sequence
  Core polypeptide
TALLEQAQIQQEKNEYELQKLAK

SEQ ID NO: 1300 - protein, 23 aa, Artificial Sequence
  Core polypeptide
TALLEQAQIQQEKGEYELQKLAK

SEQ ID NO: 1301 - protein, 23 aa, Artificial Sequence
  Core polypeptide
TALLEQAQIQQEKAEYELQKLAE

SEQ ID NO: 1302 - protein, 23 aa, Artificial Sequence
  Core polypeptide
TALLEQAQIQQEKNEYELQKLAE

SEQ ID NO: 1303 - protein, 23 aa, Artificial Sequence
  Core polypeptide
TALLEQAQIQQEKGEYELQKLAE

SEQ ID NO: 1304 - protein, 28 aa, Artificial Sequence
  Core polypeptide
DEFDASISQVNEKINQSLAFIRKSDELL

SEQ ID NO: 1305 - protein, 27 aa, Artificial Sequence
  Core polypeptide
DEYDASISQVNEKINQALAYIREADEL

SEQ ID NO: 1306 - protein, 27 aa, Artificial Sequence
  Core polypeptide
DEYDASISQVNEEINQALAYIRKADEL

SEQ ID NO: 1307 - protein, 28 aa, Artificial Sequence
  Core polypeptide
DEFDESISQVNEKIEESLAFIRKSDELL

SEQ ID NO: 1308 - protein, 27 aa, Artificial Sequence
  Core polypeptide
DEFDESISQVNEKIEESLAFIRKSDEL

SEQ ID NO: 1309 - protein, 10 aa, Artificial Sequence
  Core polypeptide
QHWSYGLRPG

SEQ ID NO: 1310 - protein, 39 aa, Artificial Sequence; identical to SEQ ID NO: 1071
  Core polypeptide

SEQ ID NO: 1311 - protein, 35 aa, Artificial Sequence; identical to SEQ ID NO: 1115
  Core polypeptide

SEQ ID NO: 1312 - protein, 35 aa, Artificial Sequence; identical to SEQ ID NO: 692
  Core polypeptide

SEQ ID NO: 1313 - protein, 28 aa, Artificial Sequence
  Core polypeptide
YTSLIHSLIEESQNQQEKNEQELLELDK

SEQ ID NO: 1314 - protein, 28 aa, Artificial Sequence
  Core polypeptide
LEENITALLEEAQIQQEKNMYELQKLNS

SEQ ID NO: 1315 - protein, 28 aa, Artificial Sequence
  Core polypeptide
LEANISQSLEQAQIQQEKNMYELQKLNS

SEQ ID NO: 1316 - protein, 28 aa, Artificial Sequence
  Core polypeptide
NNYTSLIHSLIEESQNQQEKNEQELLEL

SEQ ID NO: 1317 - protein, 28 aa, Artificial Sequence
  Core polypeptide
DFLEENITALLEEAQIQQEKNMYELQKL

SEQ ID NO: 1318 - protein, 28 aa, Artificial Sequence
  Core polypeptide
RYLEANISQSLEQAQIQQEKNMYELQKL

SEQ ID NO: 1319 - protein, 28 aa, Artificial Sequence
  Core polypeptide
RYLEANITALLEQAQIQQEKNEYELQKL

SEQ ID NO: 1320 - protein, 30 aa, Artificial Sequence; identical to SEQ ID NO: 1285
  Core polypeptide

SEQ ID NO: 1321 - protein, 23 aa, Artificial Sequence
  Core polypeptide
TALLEQAQIQQEKNEYELQKLDK

SEQ ID NO: 1322 - protein, 23 aa, Artificial Sequence
  Core polypeptide
TALLEQAQIQQEKNEYELQKLDE

SEQ ID NO: 1323 - protein, 23 aa, Artificial Sequence
  Core polypeptide
TALLEQAQIQQEKNEYELQKLIE

SEQ ID NO: 1324 - protein, 23 aa, Artificial Sequence
  Core polypeptide
TALLEQAQIQQEKIEYELQKLDK

SEQ ID NO: 1325 - protein, 23 aa, Artificial Sequence
  Core polypeptide
TALLEQAQIQQEKIEYELQKLDE

SEQ ID NO: 1326 - protein, 23 aa, Artificial Sequence
  Core polypeptide
TALLEQAQIQQEKIEYELQKLIE

SEQ ID NO: 1327 - protein, 22 aa, Artificial Sequence
  Core polypeptide
TALLEQAQIQQEKIEYELQKLE

SEQ ID NO: 1328 - protein, 23 aa, Artificial Sequence
  Core polypeptide
TALLEQAQIQQEKIEYELQKLAK

SEQ ID NO: 1329 - protein, 23 aa, Artificial Sequence
  Core polypeptide
TALLEQAQIQQEKIEYELQKLAE

SEQ ID NO: 1330 - protein, 22 aa, Artificial Sequence
  Core polypeptide
TALLEQAQIQQEKAEYELQKLE

SEQ ID NO: 1331 - protein, 22 aa, Artificial Sequence
  Core polypeptide
TALLEQAQIQQEKNEYELQKLE

SEQ ID NO: 1332 - protein, 22 aa, Artificial Sequence
  Core polypeptide
TALLEQAQIQQEKGEYELQKLE

SEQ ID NO: 1333 - protein, 23 aa, Artificial Sequence
  Core polypeptide
TALLEQAQIQQEKAEYELQKLAK

SEQ ID NO: 1334 - protein, 23 aa, Artificial Sequence
  Core polypeptide
TALLEQAQIQQEKNEYELQKLAK

SEQ ID NO: 1335 - protein, 23 aa, Artificial Sequence
  Core polypeptide
TALLEQAQIQQEKGEYELQKLAK

SEQ ID NO: 1336 - protein, 23 aa, Artificial Sequence
  Core polypeptide
TALLEQAQIQQEKAEYELQKLAE

SEQ ID NO: 1337 - protein, 23 aa, Artificial Sequence
  Core polypeptide
TALLEQAQIQQEKNEYELQKLAE

SEQ ID NO: 1338 - protein, 23 aa, Artificial Sequence
  Core polypeptide
TALLEQAQIQQEKGEYELQKLAE

SEQ ID NO: 1339 - protein, 28 aa, Artificial Sequence
  Core polypeptide
DEFDASISQVNEKINQSLAFIRKSDELL

SEQ ID NO: 1340 - protein, 27 aa, Artificial Sequence
  Core polypeptide
DEYDASISQVNEKINQALAYIREADEL

SEQ ID NO: 1341 - protein, 27 aa, Artificial Sequence
  Core polypeptide
DEYDASISQVNEEINQALAYIRKADEL

SEQ ID NO: 1342 - protein, 28 aa, Artificial Sequence
  Core polypeptide
DEFDESISQVNEKIEESLAFIRKSDELL

SEQ ID NO: 1343 - protein, 27 aa, Artificial Sequence
  Core polypeptide
DEFDESISQVNEKIEESLAFIRKSDEL

SEQ ID NO: 1344 - protein, 10 aa, Artificial Sequence
  Core polypeptide
QHWSYGLRPG

SEQ ID NO: 1345 - protein, 35 aa, Artificial Sequence
  Core polypeptide
GLSPTVWLSVIWMMWYWGPSLYSILSPFLPLLPIF

SEQ ID NO: 1346 - protein, 36 aa, Artificial Sequence
  Core polypeptide
VGLSPTVWLSVIWMMWYWWGPSLYSILSPFLPLLPI

SEQ ID NO: 1347 - protein, 35 aa, Artificial Sequence
  Core polypeptide
FVGLSPTVWLSVIWMMWYWGPSLYSILSPFLPLLP

SEQ ID NO: 1348 - protein, 35 aa, Artificial Sequence
  Core polypeptide
WFVGLSPTVWLSVIWMMWYWGPSLYSILSPFLPLL

SEQ ID NO: 1349 - protein, 35 aa, Artificial Sequence
  Core polypeptide
QWFVGLSPTVWLSVIWMMWYWGPSLYSILSPFLPL

SEQ ID NO: 1350 - protein, 35 aa, Artificial Sequence
  Core polypeptide
VQWFVGLSPTVWLSVIWMMWYWGPSLYSILSPFLP

SEQ ID NO: 1351 - protein, 35 aa, Artificial Sequence
  Core polypeptide
FVQWFVGLSPTVWLSVIWMMWYWGPSLYSILSPFL

SEQ ID NO: 1352 - protein, 35 aa, Artificial Sequence
  Core polypeptide
PFVQWFVGLSPTVWLSVIWMMWYWGPSLYSILSPF

SEQ ID NO: 1353 - protein, 35 aa, Artificial Sequence
  Core polypeptide
VPFVQWFVGLSPTVWLSVIWMMWYWGPSLYSILSP

SEQ ID NO: 1354 - protein, 35 aa, Artificial Sequence
  Core polypeptide
LVPFVQWFVGLSPTVWLSVIWMMWYWGPSLYSILS

SEQ ID NO: 1355 - protein, 35 aa, Artificial Sequence
  Core polypeptide
LQAGFFLLTRILTIPQSLDSWWTSLNFLGGTTVAL

SEQ ID NO: 1356 - protein, 36 aa, Artificial Sequence
  Core polypeptide
WNWFIHSLIEESQNQQEKNEQELLELDKWASLWNWF

SEQ ID NO: 1357 - protein, 36 aa, Artificial Sequence
  Core polypeptide
YTNTIYTLLEESQNQQEKNEQELLELDKWASLWNWF

SEQ ID NO: 1358 - protein, 36 aa, Artificial Sequence
  Core polypeptide
YTGIIYNLLEESQNQQEKNEQELLELDKWANLWNWF

SEQ ID NO: 1359 - protein, 36 aa, Artificial Sequence; identical to SEQ ID NO: 1358
  Core polypeptide

SEQ ID NO: 1360 - protein, 36 aa, Artificial Sequence
  Core polypeptide
YTSLIYSLLEKSQIQQEKNEQELLELDKWASLWNWF

SEQ ID NO: 1361 - protein, 36 aa, Artificial Sequence
  Core polypeptide
YTSLIYSLLEKSQIQQEKNEQELLQLDKWASLWNWF

SEQ ID NO: 1362 - protein, 21 aa, Artificial Sequence
  Core polypeptide
EKSQIQQEKNEQELLELDKWA

SEQ ID NO: 1363 - skipped
  Core polypeptide

SEQ ID NO: 1364 - protein, 21 aa, Artificial Sequence
  Core polypeptide
EQAQIQQEKNEYELQKLDKWA

SEQ ID NO: 1365 - protein, 21 aa, Artificial Sequence
  Core polypeptide
EQAQIQQEKNEYELQKLDKWA

SEQ ID NO: 1366 - protein, 36 aa, Artificial Sequence
  Core polypeptide
  SITE (3)...(3): Xaa=unknown amino acid
  SITE (10)...(10): Xaa=unknown amino acid
  SITE (17)...(17): Xaa=unknown amino acid
  SITE (24)...(24): Xaa=unknown amino acid
YTXLIHSLIXESQNQQXKNEQELXELDKWASLWNWF

SEQ ID NO: 1367 - protein, 27 aa, Artificial Sequence
  Core polypeptide
  SITE (3)...(3): Xaa=unknown amino acid
  SITE (10)...(10): Xaa=unknown amino acid
  SITE (17)...(17): Xaa=unknown amino acid
  SITE (24)...(24): Xaa=unknown amino acid
YTXLIHSLIXESQNQQXKNEQELXELD

SEQ ID NO: 1368 - protein, 27 aa, Artificial Sequence
  Core polypeptide
YTSLIHSLIEESQNQQEKNEQELLELD

SEQ ID NO: 1369 - protein, 39 aa, Artificial Sequence
  Core polypeptide
  SITE (6)...(6): Xaa=unknown amino acid
  SITE (13)...(13): Xaa=unknown amino acid
  SITE (20)...(20): Xaa=unknown amino acid
  SITE (27)...(27): Xaa=unknown amino acid
WQEWEXKITALLXQAQIQQXKNEYELXKLDKWASLWEWF

SEQ ID NO: 1370 - protein, 34 aa, Artificial Sequence
  Core polypeptide
  SITE (1)...(1): Xaa=unknown amino acid
  SITE (8)...(8): Xaa=unknown amino acid
  SITE (15)...(15): Xaa=unknown amino acid
  SITE (22)...(22): Xaa=unknown amino acid
XKITALLXQAQIQQXKNEYELXKLDKWASLWEWF

SEQ ID NO: 1371 - protein, 30 aa, Artificial Sequence
  Core polypeptide
  SITE (6)...(6): Xaa=unknown amino acid
  SITE (13)...(13): Xaa=unknown amino acid
  SITE (20)...(20): Xaa=unknown amino acid
  SITE (27)...(27): Xaa=unknown amino acid
WQEWEXKITALLXQAQIQQXKNEYELXKLD

SEQ ID NO: 1372 - protein, 27 aa, Artificial Sequence
  Core polypeptide
WEQKITALLEQAQIQQEKNEYELQKLD

SEQ ID NO: 1373 - protein, 25 aa, Artificial Sequence
  Core polypeptide
  SITE (3)...(3): Xaa=unknown amino acid
  SITE (10)...(10): Xaa=unknown amino acid
  SITE (15)...(15): Xaa=unknown amino acid
  SITE (22)...(22): Xaa=unknown amino acid
WEXKITALLXQAQQXKNEYELXKLD

SEQ ID NO: 1374 - protein, 25 aa, Artificial Sequence
  Core polypeptide
  SITE (1)...(1): Xaa=unknown amino acid
  SITE (8)...(8): Xaa=unknown amino acid
  SITE (15)...(15): Xaa=unknown amino acid
  SITE (22)...(22): Xaa=unknown amino acid
XKITALLXQAQIQQXKNEYELXKLD

SEQ ID NO: 1375 - protein, 25 aa, Artificial Sequence
  Core polypeptide
QKITALLEQAQIQQEKNEYELQKLD

SEQ ID NO: 1376 - protein, 32 aa, Artificial Sequence
  Core polypeptide
VYPSDEYDASISQVNEEINQALAYIRKADELL

SEQ ID NO: 1377 - protein, 25 aa, Artificial Sequence
  Core polypeptide
QKITALLEQAQIQQEKNEYELQKLD

SEQ ID NO: 1378 - protein, 31 aa, Artificial Sequence
  Core polypeptide
VYPSDEYDASISQVNEEINQALAYIRKADEL

SEQ ID NO: 1379 - protein, 30 aa, Artificial Sequence
  Core polypeptide
WQEWEQKITALLEQAQIQQEKNEYELQKLD

SEQ ID NO: 1380 - protein, 34 aa, Artificial Sequence
  Core polypeptide
VYPSDEYDASISQVNEEINQALAYIRKADELLEN

SEQ ID NO: 1381 - protein, 34 aa, Artificial Sequence
  Core polypeptide
QKITALLEQAQIQQEKNEYELQKLDKWASLWEWF

SEQ ID NO: 1382 - protein, 35 aa, Artificial Sequence
  Core polypeptide
STNKAVVSLSNGVSVLTSKVLDLKNYIDKQLLPIV

SEQ ID NO: 1383 - protein, 35 aa, Artificial Sequence
  Core polypeptide
TNKAVVSLSNGVSVLTSKVLDLKNYIDKQLLPIVN

SEQ ID NO: 1384 - protein, 35 aa, Artificial Sequence
  Core polypeptide
NKAVVSLSNGVSVLTSKVLDLKNYIDKQLLPIVNK

SEQ ID NO: 1385 - protein, 35 aa, Artificial Sequence
  Core polypeptide
KAVVSLSNGVSVLTSKVLDLKNYIDKQLLPIVNKQ

SEQ ID NO: 1386 - protein, 36 aa, Artificial Sequence
  Core polypeptide
AVVSLSNGVSVLTSKVLDLLKNYIDKQLLPIVNKQS

SEQ ID NO: 1387 - protein, 34 aa, Artificial Sequence
  Core polypeptide
VVSLSNGVSVLTSKVLDLKNYIDKQLLPIVNKQS

SEQ ID NO: 1388 - protein, 34 aa, Artificial Sequence
  Core polypeptide
VSLSNGVSVLTSKVLDLKNYIDKQLLPIVNKQSS

SEQ ID NO: 1389 - protein, 34 aa, Artificial Sequence
  Core polypeptide
SLSNGVSVLTSKVLDLKNYIDKQLLPIVNKQSSI

SEQ ID NO: 1390 - protein, 34 aa, Artificial Sequence
  Core polypeptide
LSNGVSVLTSKVLDLKNYIDKQLLPIVNKQSSIS

SEQ ID NO: 1391 - protein, 34 aa, Artificial Sequence
  Core polypeptide
SNGVSVLTSKVLDLKNYIDKQLLPIVNKQSSISN

SEQ ID NO: 1392 - protein, 34 aa, Artificial Sequence
  Core polypeptide
NGVSVLTSKVLDLKNYIDKQLLPIVNKQSSISNI

SEQ ID NO: 1393 - protein, 34 aa, Artificial Sequence
  Core polypeptide
GVSVLTSKVLDLKNYIDKQLLPIVNKQSSISNIE

SEQ ID NO: 1394 - protein, 34 aa, Artificial Sequence
  Core polypeptide
VSVLTSKVLDLKNYIDKQLLPIVNKQSSISNIET

SEQ ID NO: 1395 - protein, 34 aa, Artificial Sequence
  Core polypeptide
SVLTSKVLDLKNYIDKQLLPIVNKQSSISNIETV

SEQ ID NO: 1396 - protein, 34 aa, Artificial Sequence
  Core polypeptide
VLTSKVLDLKNYIDKQLLPIVNKQSSISNIETVI

SEQ ID NO: 1397 - protein, 33 aa, Artificial Sequence
  Core polypeptide
LTSKVLDKNYIDKQLLPIVNKQSSISNIETVIE

SEQ ID NO: 1398 - protein, 34 aa, Artificial Sequence
  Core polypeptide
TSKVLDLKNYIDKQLLPIVNKQSSISNIETVIEF

SEQ ID NO: 1399 - protein, 34 aa, Artificial Sequence
  Core polypeptide
SKVLDLKNYIDKQLLPIVNKQSSISNIETVIEFQ

SEQ ID NO: 1400 - protein, 34 aa, Artificial Sequence
  Core polypeptide
KVLDLKNYIDKQLLPIVNKQSSISNIETVIEFQQ

SEQ ID NO: 1401 - protein, 34 aa, Artificial Sequence
  Core polypeptide
VLDLKNYIDKQLLPIVNKQSSISNIETVIEFQQK

SEQ ID NO: 1402 - protein, 34 aa, Artificial Sequence
  Core polypeptide
LDLKNYIDKQLLPIVNKQSSISNIETVIEFQQKN

SEQ ID NO: 1403 - protein, 34 aa, Artificial Sequence
  Core polypeptide
DLKNYIDKQLLPIVNKQSSISNIETVIEFQQKNN

SEQ ID NO: 1404 - protein, 34 aa, Artificial Sequence
  Core polypeptide
LKNYIDKQLLPIVNKQSSISNIETVIEFQQKNNR

SEQ ID NO: 1405 - protein, 34 aa, Artificial Sequence
  Core polypeptide
KNYIDKQLLPIVNKQSSISNIETVIEFQQKNNRL

SEQ ID NO: 1406 - protein, 35 aa, Artificial Sequence
  Core polypeptide
NYIDKQLLPIVNKQSISISNIETVIEFQQKNNRLL

SEQ ID NO: 1407 - protein, 34 aa, Artificial Sequence
  Core polypeptide
YIDKQLLPIVNKQSSISNIETVIEFQQKNNRLLE

SEQ ID NO: 1408 - protein, 34 aa, Artificial Sequence
  Core polypeptide
IDKQLLPIVNKQSSISNIETVIEFQQKNNRLLEI

SEQ ID NO: 1409 - protein, 34 aa, Artificial Sequence
  Core polypeptide
DKQLLPIVNKQSSISNIETVIEFQQKNNRLLEIT

SEQ ID NO: 1410 - protein, 34 aa, Artificial Sequence
  Core polypeptide
KQLLPIVNKQSSISNIETVIEFQQKNNRLLEITR

SEQ ID NO: 1411 - protein, 34 aa, Artificial Sequence
  Core polypeptide
QLLPIVNKQSSISNIETVIEFQQKNNRLLEITRE

SEQ ID NO: 1412 - protein, 23 aa, Artificial Sequence
  Core polypeptide
VYPSDEYDASISQVNEEINQALA

SEQ ID NO: 1413 - protein, 23 aa, Artificial Sequence
  Core polypeptide
QVNEEINQALAYIRKADELLENV

SEQ ID NO: 1414 - protein, 35 aa, Artificial Sequence; identical to SEQ ID NO: 692
  Core polypeptide

SEQ ID NO: 1415 - protein, 27 aa, Artificial Sequence
  Core polypeptide
DEYDASISQVNEEINQALAYIREADEL

SEQ ID NO: 1416 - protein, 27 aa, Artificial Sequence
  Core polypeptide
DEYDASISQVNEKINQALAYIREADEL

SEQ ID NO: 1417 - protein, 35 aa, Artificial Sequence; identical to SEQ ID NO: 1240
  Core polypeptide

SEQ ID NO: 1418 - protein, 34 aa, Artificial Sequence
  Core polypeptide
DDELNSVKNGTYDFPKFEEESKLNRNEIKGVKLS

SEQ ID NO: 1419 - protein, 39 aa, Artificial Sequence
  Core polypeptide
YHKCDDECLNSVKNGTFDFPKFEEESKLNREIKGVKLSS

SEQ ID NO: 1420 - protein, 38 aa, Artificial Sequence
  Core polypeptide
YHKDDELNSVKNGTFDFPKFEEESKLNRNEIKGVKLSS

SEQ ID NO: 1421 - protein, 36 aa, Artificial Sequence; identical to SEQ ID NO: 1246
  Core polypeptide

SEQ ID NO: 1422 - protein, 36 aa, Artificial Sequence; identical to SEQ ID NO: 1247
  Core polypeptide

SEQ ID NO: 1423 - protein, 36 aa, Artificial Sequence; identical to SEQ ID NO: 1248
  Core polypeptide

SEQ ID NO: 1424 - protein, 36 aa, Artificial Sequence; identical to SEQ ID NO: 1249
  Core polypeptide

SEQ ID NO: 1425 - protein, 36 aa, Artificial Sequence; identical to SEQ ID NO: 1250
  Core polypeptide

SEQ ID NO: 1426 - protein, 36 aa, Artificial Sequence; identical to SEQ ID NO: 1251
  Core polypeptide

SEQ ID NO: 1427 - protein, 35 aa, Artificial Sequence
  Core polypeptide
YTSLIHSLIEESQIQQEKNEYELQKLDWASLWEWF

SEQ ID NO: 1428 - protein, 36 aa, Artificial Sequence; identical to SEQ ID NO: 1253
  Core polypeptide

SEQ ID NO: 1429 - protein, 36 aa, Artificial Sequence; identical to SEQ ID NO: 1254
  Core polypeptide

SEQ ID NO: 1430 - protein, 36 aa, Artificial Sequence; identical to SEQ ID NO: 1255
  Core polypeptide

SEQ ID NO: 1431 - protein, 35 aa, Artificial Sequence
  Core polypeptide
WQEWEQKITALLEQAQIQQEKNEYELQKLDKWEWF

SEQ ID NO: 1432 - protein, 39 aa, Artificial Sequence
  Core polypeptide
WQEWEQKITALLEQAQIQQEKNEYELQKLIEWASLWEWF

SEQ ID NO: 1433 - protein, 8 aa, Artificial Sequence
  Core polypeptide
WASLWEWF

SEQ ID NO: 1434 - protein, 35 aa, Artificial Sequence; identical to SEQ ID NO: 1122
  Core polypeptide

SEQ ID NO: 1435 - protein, 35 aa, Artificial Sequence; identical to SEQ ID NO: 1123
  Core polypeptide

SEQ ID NO: 1436 - protein, 31 aa, Artificial Sequence
  Core polypeptide
WQAWDEYDASISDVNEKINQALAYIREADEL

SEQ ID NO: 1437 - skipped

SEQ ID NO: 1438 - protein, 40 aa, Artificial sequence
  Core polypeptide
GWQEWEQRITALLEQAQIQQERNEYELQRLDEWASLWEWF

SEQ ID NO: 1439 - protein, 40 aa, Artificial sequence; identical to SEQ ID NO: 1438
  Core polypeptide

SEQ ID NO: 1440 - protein, 36 aa, Artificial sequence
  Core polypeptide
YTSLITALLEQAQIQQERNEQELLELDEWASLWEWF

SEQ ID NO: 1441 - protein, 36 aa, Artificial sequence; identical to SEQ ID NO: 1440
  Core polypeptide

SEQ ID NO: 1442 - protein, 40 aa, Artificial sequence
  Core polypeptide
GWQEWEQRITALLEQAQIQQERNEYELQELDEWASLWEWF

SEQ ID NO: 1443 - protein, 40 aa, Artificial sequence; identical to SEQ ID NO: 1442
  Core polypeptide

SEQ ID NO: 1444 - protein, 36 aa, Artificial sequence; identical to SEQ ID NO: 1223
  Core polypeptide

SEQ ID NO: 1445 - protein, 40 aa, Artificial sequence
  Core polypeptide
GWQEWEQRITALLEQAQIQQERNEYELQRLDRWASLWEWF

SEQ ID NO: 1446 - protein, 40 aa, Artificial sequence; identical to SEQ ID NO: 1445
  Core polypeptide

SEQ ID NO: 1447 - protein, 40 aa, Artificial sequence
  Core polypeptide
GWQEWEQRITALLEQAQIQQERNEYELQELDRWASLWEWF

SEQ ID NO: 1448 - protein, 40 aa, Artificial sequence; identical to SEQ ID NO: 1447
  Core polypeptide

SEQ ID NO: 1449 - protein, 36 aa, Artificial sequence
  Core polypeptide
YTSLIGSLIEESQNQQERNEQELLELDRWASLWNWF

SEQ ID NO: 1450 - protein, 36 aa, Artificial sequence; identical to SEQ ID NO: 1449
  Core polypeptide

SEQ ID NO: 1451 - protein, 18 aa, Artificial sequence
  Core polypeptide
YTSLIHSLIEESQNQQEK

SEQ ID NO: 1452 - protein, 18 aa, Artificial sequence
  Core polypeptide
NEQELLELDKWASLWNWF

SEQ ID NO: 1453 - protein, 39 aa, Artificial sequence
  Core polypeptide
AAAWEQKITALLEQAQIQQEKNEYELQKLDKWASLWEWF

SEQ ID NO: 1454 - protein, 39 aa, Artificial sequence
  Core polypeptide
WQEAAAKITALLEQAQIQQEKNEYELQKLDKWASLWEWF

SEQ ID NO: 1455 - protein, 39 aa, Artificial sequence
  Core polypeptide
WQEWEQAAAALLEQAQIQQEKNEYELQKLDKWASLWEWF

SEQ ID NO: 1456 - protein, 39 aa, Artificial sequence
  Core polypeptide
WQEWEQKITAAAEQAQIQQEKNEYELQKLDKWASLWEWF

SEQ ID NO: 1457 - protein, 39 aa, Artificial sequence
  Core polypeptide
WQEWEQKITALLAAAQIQQEKNEYELQKLDKWASLWEWF

SEQ ID NO: 1458 - protein, 39 aa, Artificial sequence
  Core polypeptide
WQEWEQKITALLEQAAAAQEKNEYELQKLDKWASLWEWF

SEQ ID NO: 1459 - protein, 39 aa, Artificial sequence
  Core polypeptide
WQEWEQKITALLEQAQIQAAANEYELQKLDKWASLWEWF

SEQ ID NO: 1460 - protein, 39 aa, Artificial sequence
  Core polypeptide
WQEWEQKITALLEQAQIQQEKAAAELQKLDKWASLWEWF

SEQ ID NO: 1461 - protein, 39 aa, Artificial sequence
  Core polypeptide
WQEWEQKITALLEQAQIQQEKNEYAAAKLDKWASLWEWF

SEQ ID NO: 1462 - protein, 39 aa, Artificial sequence
  Core polypeptide
WQEWEQKITALLEQAQIQQEKNEYELQAAAKWASLWEWF

SEQ ID NO: 1463 - protein, 39 aa, Artificial sequence
  Core polypeptide
WQEWEQKITALLEQAQIQQEKNEYELQKLDAAASLWEWF

SEQ ID NO: 1464 - protein, 39 aa, Artificial sequence
  Core polypeptide
WQEWEQKITALLEQAQIQQEKNEYELQKLDKWAAAAEWF

SEQ ID NO: 1465 - protein, 39 aa, Artificial sequence
  Core polypeptide
WQEWEQKITALLEQAQIQQEKNEYELQKLDKWASLWAAA

SEQ ID NO: 1466 - protein, 35 aa, Artificial sequence
  Core polypeptide
YTSLIHSLIEESQNQQEKNEQELLLDKWASLWNWF

SEQ ID NO: 1467 - protein, 35 aa, Artificial sequence
  Core polypeptide
YTSLIHSLIEESQNQEKNEQELLELDKWASLWNWF

SEQ ID NO: 1468 - protein, 9 aa, Artificial sequence
  Core polypeptide
ERTLDFHDS

SEQ ID NO: 1469 - protein, 36 aa, Artificial sequence; identical to SEQ ID NO: 15
  Core polypeptide

SEQ ID NO: 1470 - protein, 36 aa, Artificial sequence; identical to SEQ ID NO: 15
  Core polypeptide

SEQ ID NO: 1471 - protein, 26 aa, Artificial sequence
  Core polypeptide
YTSLIHSLIEESQNQQDKWASLWNWF

SEQ ID NO: 1472 - protein, 35 aa, Artificial sequence
  Core polypeptide
FYEIIMDIEQNNVQGKKGIQQLQKWEDWVGWIGNI

SEQ ID NO: 1473 - protein, 35 aa, Artificial sequence
  Core polypeptide
INQTIWNHGNITLGEWYNQTKDLQQKFYEIIMDIE

SEQ ID NO: 1474 - protein, 35 aa, Artificial sequence
  Core polypeptide
WNHGNITLGEWYNQTKDLQQKFYEIIMDIEQNNVQ

SEQ ID NO: 1475 - protein, 36 aa, Artificial sequence
  Core polypeptide
YTSLIHSLIEESENQQEKNEQELLELDKWASLWNWF

SEQ ID NO: 1476 - protein, 36 aa, Artificial sequence; identical to SEQ ID NO: 729
  Core polypeptide

SEQ ID NO: 1477 - protein, 36 aa, Artificial sequence
  Core polypeptide
YTSLIHSLIEESQNEQEKNEQELLELDKWASLWNWF

SEQ ID NO: 1478 - protein, 36 aa, Artificial sequence
  Core polypeptide
YTSLIHSLIEESQNQEEKNEQELLELDKWASLWNWF

SEQ ID NO: 1479 - protein, 36 aa, Artificial sequence; identical to SEQ ID NO: 728
  Core polypeptide

SEQ ID NO: 1480 - protein, 35 aa, Artificial sequence
  Core polypeptide
LGEWYNQTKDLQQKFYEIIMDIEQNNVQGKKGIQQ

SEQ ID NO: 1481 - protein, 35 aa, Artificial sequence
  Core polypeptide
WYNQTKDLQQKFYEIIMDIEQNNVQGKKGIQQLQK

SEQ ID NO: 1482 - protein, 36 aa, Artificial sequence
  Core polypeptide
YTSLIHSLIEESQNQQEKNEEELLELDKWASLWNWF

SEQ ID NO: 1483 - protein, 36 aa, Artificial sequence; identical to SEQ ID NO: 731
  Core polypeptide

SEQ ID NO: 1484 - protein, 36 aa, Artificial sequence
  Core polypeptide
  SITE (1)...(1): Xaa=unknown amino acid
  SITE (36)...(36): Xaa=unknown amino acid
XTSLIHSLIEESQNQQEKNEQELLELDKWASLWNWX

SEQ ID NO: 1485 - protein, 35 aa, Artificial sequence
  Core polypeptide
YNQTKDLQQKFYEIIMDIEQNNVQGKKGIQQLQKW

SEQ ID NO: 1486 - protein, 36 aa, Artificial sequence; identical to SEQ ID NO: 15
  Core polypeptide

SEQ ID NO: 1487 - protein, 44 aa, Artificial sequence
  Core polypeptide
TLTVQARQLLSGIVQQQNNLLRAIEAQQHLLQLTVWGIKQLQAR

SEQ ID NO: 1488 - protein, 35 aa, Artificial sequence
  Core polypeptide
LQQKFYEIIMDIEQNNVQGKKGIQQLQKWEDWVGW

SEQ ID NO: 1489 - protein, 36 aa, Artificial sequence
  Core polypeptide
YTSLIHSLIEESQNQQEKNEQELLALDKWASLWNWF

SEQ ID NO: 1490 - protein, 36 aa, Artificial sequence
  Core polypeptide
YTSLIHSLIEESQNQQEKNEQELLEADKWASLWNWF

SEQ ID NO: 1491 - protein, 36 aa, Artificial sequence
  Core polypeptide
YTSLIHSLIEESQNQQEKNEQELLELAKWASLWNWF

SEQ ID NO: 1492 - protein, 36 aa, Artificial sequence
  Core polypeptide
YTSLIHSLIEESQNQQEKAEQELLELDKWASLWNWF

SEQ ID NO: 1493 - protein, 36 aa, Artificial sequence
  Core polypeptide
YTSLIHSLIEESQNQQEKNAQELLELDKWASLWNWF

SEQ ID NO: 1494 - protein, 36 aa, Artificial sequence
  Core polypeptide
YTSLIHSLIEESQNQQEKNEAELLELDKWASLWNWF

SEQ ID NO: 1495 - protein, 39 aa, Artificial sequence
  Core polypeptide
WQEWEQKITALLEQAQIQQEKNEQELQKLDKWASLWEWF

SEQ ID NO: 1496 - protein, 39 aa, Artificial sequence
  Core polypeptide
WQEWEQKITALLEQAQIQQEKAEYELQKLDKWASLWEWF

SEQ ID NO: 1497 - protein, 39 aa, Artificial sequence
  Core polypeptide
WQEWEQKITALLEQAQIQQEKNAYELQKLDKWASLWEWF

SEQ ID NO: 1498 - protein, 39 aa, Artificial sequence
  Core polypeptide
WQEWEQKITALLEQAQIQQEKNEAELQKLDKWASLWEWF

SEQ ID NO: 1499 - protein, 9 aa, Artificial sequence
  Core polypeptide
EYDLRRWEK

SEQ ID NO: 1500 - protein, 9 aa, Artificial sequence
  Core polypeptide
EQELLELDK

SEQ ID NO: 1501 - protein, 9 aa, Artificial sequence
  Core polypeptide
EYELQKLDK

SEQ ID NO: 1502 - protein, 39 aa, Artificial sequence
  Core polypeptide
WQEWEQKITALLEQAQIQQEKNEQELLKLDKWASLWEWF

SEQ ID NO: 1503 - protein, 39 aa, Artificial sequence
  Core polypeptide
WQEWEQKITALLEQAQIQQEKNEQELLELDKWASLWEWF

SEQ ID NO: 1504 - protein, 32 aa, Artificial sequence
  Core polypeptide
WQEWEQKITALLEQAQIQQEKNDKWASLWEWF

SEQ ID NO: 1505 - protein, 36 aa, Artificial sequence
  Core polypeptide
YTSLIHSLIEESQNQAEKNEQELLELDKWASLWNWF

SEQ ID NO: 1506 - protein, 36 aa, Artificial sequence
  Core polypeptide
YTSLIHSLIEESQNQQAKNEQELLELDKWASLWNWF

SEQ ID NO: 1507 - protein, 36 aa, Artificial sequence
  Core polypeptide
YTSLIHSLIEESQNQQEANEQELLELDKWASLWNWF

SEQ ID NO: 1508 - protein, 36 aa, Artificial sequence
  Core polypeptide
YTSLIHSLIEESANQQEANEQELLELDKWASLWNWF

SEQ ID NO: 1509 - protein, 38 aa, Artificial sequence
  Core polypeptide
YTSLIHSLIEESQAQQEKNEQELLELDKWASLWNWFNH

SEQ ID NO: 1510 - protein, 36 aa, Artificial sequence
  Core polypeptide
YTSLIHSLIEESQNAQEKNEQELLELDKWASLWNWF

SEQ ID NO: 1511 - protein, 36 aa, Artificial sequence
  Core polypeptide
YTSLIHALIEESQNQQEKNEQELLELDKWASLWNWF

SEQ ID NO: 1512 - protein, 36 aa, Artificial sequence
  Core polypeptide
YTSLIHSAIEESQNQQEKNEQELLELDKWASLWNWF

SEQ ID NO: 1513 - protein, 35 aa, Artificial sequence; identical to SEQ ID NO: 692
  Core polypeptide

SEQ ID NO: 1514 - protein, 36 aa, Artificial sequence
  Core polypeptide
YTSLIHSLAEESQNQQEKNEQELLELDKWASLWNWF

SEQ ID NO: 1515 - protein, 36 aa, Artificial sequence
  Core polypeptide
YTSAIHSLIEESQNQQEKNEQELLELDKWASLWNWF

SEQ ID NO: 1516 - protein, 36 aa, Artificial sequence
  Core polypeptide
YTSLAHSLIEESQNQQEKNEQELLELDKWASLWNWF

SEQ ID NO: 1517 - protein, 36 aa, Artificial sequence
  Core polypeptide
YTSLIASLIEESQNQQEKNEQELLELDKWASLWNWF

SEQ ID NO: 1518 - protein, 36 aa, Artificial sequence
  Core polypeptide
ATSLIHSLIEESQNQQEKNEQELLELDKWASLWNWF

SEQ ID NO: 1519 - protein, 36 aa, Artificial sequence
  Core polypeptide
YASLIHSLIEESQNQQEKNEQELLELDKWASLWNWF

SEQ ID NO: 1520 - protein, 36 aa, Artificial sequence
  Core polypeptide
YTALIHSLIEESQNQQEKNEQELLELDKWASLWNWF

SEQ ID NO: 1521 - protein, 30 aa, Artificial sequence
  Core polypeptide
RIQDLEKYVEDTKIDLWSYNAELLVALENQ

SEQ ID NO: 1522 - protein, 24 aa, Artificial sequence
  Core polypeptide
HTIDLTDSEMNKLFEKTRRQLREN

SEQ ID NO: 1523 - protein, 17 aa, Artificial sequence
  Core polypeptide
SEMNKLFEKTRRQLREN

SEQ ID NO: 1524 - protein, 35 aa, Artificial sequence
  Core polypeptide
VFPSDEADASISQVNEKINQSLAFIRKSDELLHNV

SEQ ID NO: 1525 - protein, 35 aa, Artificial sequence
  Core polypeptide
VFPSDEFAASISQVNEKINQSLAFIRKSDELLHNV

SEQ ID NO: 1526 - protein, 35 aa, Artificial sequence
  Core polypeptide
VFPSDEFDASISAVNEKINQSLAFIRKSDELLHNV

SEQ ID NO: 1527 - protein, 35 aa, Artificial sequence
  Core polypeptide
VFPSDEFDASISQANEKINQSLAFIRKSDELLHNV

SEQ ID NO: 1528 - protein, 35 aa, Artificial sequence
  Core polypeptide
VFPSDEFDASISQVAEKINQSLAFIRKSDELLHNV

SEQ ID NO: 1529 - protein, 39 aa, Artificial sequence
  Core polypeptide
WQEWEQKITAALEQAQIQQEKNEYELQKLDKWASLWEWF

SEQ ID NO: 1530 - protein, 39 aa, Artificial sequence
  Core polypeptide
WQEWEQKITALAEQAQIQQEKNEYELQKLDKWASLWEWF

SEQ ID NO: 1531 - protein, 39 aa, Artificial sequence
  Core polypeptide
WQEWEQKITALLEQAAIQQEKNEYELQKLDKWASLWEWF

SEQ ID NO: 1532 - protein, 39 aa, Artificial sequence
  Core polypeptide
WQEWEQKITALLEQAQAQQEKNEYELQKLDKWASLWEWF

SEQ ID NO: 1533 - protein, 39 aa, Artificial sequence
  Core polypeptide
WQEWEQKITALLEQAQIAQEKNEYELQKLDKWASLWEWF

SEQ ID NO: 1534 - protein, 39 aa, Artificial sequence
  Core polypeptide
WQEWEQKITALLEQAQIQAEKNEYELQKLDKWASLWEWF

SEQ ID NO: 1535 - protein, 35 aa, Artificial sequence
  Core polypeptide
VFPSDEFDASISQVNEKINQSAAFIRKSDELLHNV

SEQ ID NO: 1536 - protein, 35 aa, Artificial sequence
  Core polypeptide
VFPSDEFDASISQVNEKINQSLAAIRKSDELLHNV

SEQ ID NO: 1537 - protein, 35 aa, Artificial sequence
  Core polypeptide
VFPSDEFDASISQVNEKINQSLAFIRKSDEALHNV

SEQ ID NO: 1538 - protein, 35 aa, Artificial sequence
  Core polypeptide
VFPSDEFDASISQVNEKINQSLAFIRKSDELAHNV

SEQ ID NO: 1539 - protein, 35 aa, Artificial sequence
  Core polypeptide
VFPSDEFDASISQVNEKINQSLAFIRKSDELLANV

SEQ ID NO: 1540 - protein, 39 aa, Artificial sequence
  Core polypeptide
WQEWEQKITALLEQAQIQQAKNEYELQKLDKWASLWEWF

SEQ ID NO: 1541 - protein, 39 aa, Artificial sequence
  Core polypeptide
WQEWEQKITALLEQAQIQQEKNEYELQALDKWASLWEWF

SEQ ID NO: 1542 - protein, 39 aa, Artificial sequence
  Core polypeptide
WQEWEQKITALLEQAQIQQEKNEYELQKADKWASLWEWF

SEQ ID NO: 1543 - protein, 36 aa, Human immunodeficiency virus type 1
YTNTIYNLLEESQNQQEKNEQELLELDKWASLWNWF

SEQ ID NO: 1544 - protein, 36 aa, Human immunodeficiency virus type 1
YTSLIYSLLEKSQTQQEKNEQELLELDKWASLWNWF

SEQ ID NO: 1545 - protein, 36 aa, Human immunodeficiency virus type 1
LEANISKSLEQAQIQQEKNMYELQKLNSWDIFGNWF

SEQ ID NO: 1546 - protein, 36 aa, Human immunodeficiency virus type 1
LEANISQSLEQAQIQQEKNMYELQKLNSWDVFTNWF

SEQ ID NO: 1547 - protein, 16 aa, Human immunodeficiency virus type 1
LQARILAVERYLKDQQ

SEQ ID NO: 1548 - protein, 38 aa, Human immunodeficiency virus type 1
NNLLRAIEAQQHLLQLTVWQIKQLQARILAVERYLKDQ

SEQ ID NO: 1549 - protein, 28 aa, Human immunodeficiency virus type 1
MKQLEDKVEELLSKNYHLENEVARLKKL

SEQ ID NO: 1550 - protein, 28 aa, Human immunodeficiency virus type 1
TDTLQAETDQLEDEKSALQTEIANLLKE

SEQ ID NO: 1551 - protein, 28 aa, Human immunodeficiency virus type 1
IARLEEKVKTLKAQNSELASTANMLREQ

SEQ ID NO: 1552 - protein, 28 aa, Human immunodeficiency virus type 1
EQKLISEEDLLEKRREQLKHKLEQLRNS

SEQ ID NO: 1553 - protein, 28 aa, Human immunodeficiency virus type 1
IEKTNEKFHQIEKEFSEVEGRIQDLEKY

SEQ ID NO: 1554 - protein, 28 aa, Human immunodeficiency virus type 1
NNLLRAIEAQQHLLQLTVWGIKQLQARI

SEQ ID NO: 1555 - protein, 35 aa, Human immunodeficiency virus type 1
NNLLRAIEAQQHLLQLTVWGIKQLQARILAVERYL

SEQ ID NO: 1556 - protein, 39 aa, Human immunodeficiency virus type 1
NNLLRAIEAQQHLLLQLTVWGIKQLQARILAVERYLKDQ

SEQ ID NO: 1557 - protein, 28 aa, Human immunodeficiency virus type 1
NNLLRAIEAQQHLLQLTVWGIKQLQARI

SEQ ID NO: 1558 - protein, 35 aa, Human immunodeficiency virus type 1; identical to SEQ ID NO: 1555

SEQ ID NO: 1559 - protein, 39 aa, Human immunodeficiency virus type 1
NNLLRAIEEAQQHLLQLTVWGIKQLQARILAVERYLKDQ

SEQ ID NO: 1560 - protein, 28 aa, Human immunodeficiency virus type 1
YTSLIHSLIEESQNQQEKNEQELLELDK

SEQ ID NO: 1561 - protein, 35 aa, Human immunodeficiency virus type 1; identical to SEQ ID NO: 795

SEQ ID NO: 1562 - protein, 36 aa, Human immunodeficiency virus type 1; identical to SEQ ID NO: 15

SEQ ID NO: 1563 - protein, 28 aa, Human immunodeficiency virus type 1
YTSLIHSLIEESQNQQEKNEQELLELDK

SEQ ID NO: 1564 - protein, 35 aa, Human immunodeficiency virus type 1; identical to SEQ ID NO: 795

SEQ ID NO: 1565 - protein, 36 aa, Human immunodeficiency virus type 1; identical to SEQ ID NO: 15

SEQ ID NO: 1566 - protein, 28 aa, Human immunodeficiency virus type 1
MKQLEDKVEELLSKNYHLENEVARLKKL

SEQ ID NO: 1567 - protein, 28 aa, Human immunodeficiency virus type 1
NNLLRAIEAQQHLLQLTVWGIKQLQARI

SEQ ID NO: 1568 - protein, 35 aa, Human immunodeficiency virus type 1; identical to SEQ ID NO: 1555

SEQ ID NO: 1569 - protein, 38 aa, Human immunodeficiency virus type 1; identical to SEQ ID NO: 16

SEQ ID NO: 1570 - protein, 28 aa, Human immunodeficiency virus type 1
NNLLRAIEAQQHLLQLTVWGIKQLQARI

SEQ ID NO: 1571 - protein, 35 aa, Human immunodeficiency virus type 1; identical to SEQ ID NO: 1555

SEQ ID NO: 1572 - protein, 38 aa, Human immunodeficiency virus type 1; identical to SEQ ID NO: 16

SEQ ID NO: 1573 - protein, 28 aa, Human immunodeficiency virus type 1
MKQLEDKVEELLSKNYHLENEVARLKKL

SEQ ID NO: 1574 - protein, 28 aa, Human immunodeficiency virus type 1
YTSLIHSLIEESQNQQEKNEQELLELDK

SEQ ID NO: 1575 - protein, 28 aa, Human immunodeficiency virus type 1
YTSLIHSLIEESQNQQEKNEQELLELDK

SEQ ID NO: 1576 - protein, 36 aa, Human immunodeficiency virus type 1; identical to SEQ ID NO: 15

SEQ ID NO: 1577 - protein, 28 aa, Human immunodeficiency virus type 1
YTSLIHSLIEESQNQQEKNEQELLELDK

SEQ ID NO: 1578 - protein, 35 aa, Human immunodeficiency virus type 1; identical to SEQ ID NO: 795

SEQ ID NO: 1579 - protein, 36 aa, Human immunodeficiency virus type 1; identical to SEQ ID NO: 15

SEQ ID NO: 1580 - protein, 28 aa, Human immunodeficiency virus type 1
IEKTNEKFHQIEKEFSEVEGRIQDLEKY

SEQ ID NO: 1581 - protein, 326 aa, Human immunodeficiency virus type 1
FLGFLGAAGSTMGARSMTLTVQARQLLSGIVQQQNNLLRAIEAQQIILLQLTVWGIKQLQARILAVERYLKDQQLLGWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAGTDRVIEVVQGACRAIRHIPR

SEQ ID NO: 1582 - protein, 441 aa, Human immunodeficiency virus type 1
FLGFELLGVGSAIASGVAVSKVLIILEGEVNKIKSALLSTNKAVVSLSNGVSLTSKVLDLKNYIDKQLLPIVNKQSCSISNIETVIEFQQKNNRLLEITREFSVNAGVTTPVSTMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTAASNKNRGIIKTFSNGCDYVSNKGMDTVSVGNTLYYVNKQEGKSLYVKGEPIINNFYDPLVFPSDEFDASISQVNEKINQSLAFIIRKSDELLIINVNAGKSTTNIMITTIIIVIIVILLSLIAVGLLYCKARSTPVTLSKDQLSGINNIAFSN

SEQ ID NO: 1583 - protein, 328 aa, Human immunodeficiency virus type 1
FLGFLGAAGTAMGAAATALTVQSQHLLAGILQQQKNLLAAVWAQQQMLKLTIWGVKNLNARVTALEKYLEDQARLNAWGCAWKQVCHTTVPWQWNNRTPDWNNMTWLEWERQISYLEGNITTQLEEARAQEEKNLDAYQKLSSWSDFWSWFDFSKWLNILKIGFLDVLGIIGLRLLYTVYSCIARVRQGYSPLSPQIHIHPWKGQPDNAEGPGEGGDKRKNSSEPWQKESGTAEWKSNWCKRLTNWCSISSIWLYNSCLTLLVHLRSAFQYIQYGLGELKAAAQEAVVALARLAQNAGYQIWLACRSAYRAIINSPRRVRQGLEGILN

SEQ ID NO: 1584 - protein, 437 aa, Human immunodeficiency virus type 1
FAGVVLAGVALGVATAAQITAGIALHQSNLNAQAIQSLRTSLEQSNKAIEEIREATQETVIAVQGVQDYVNNELVPAMQHMSCELVGQRLGLRLLRYYTELLSIFGPSLRDPISAEISIQALIYALGGEIHKILEKLGYSGSDMIAILESRGIKTKITHVDDLPGKFIISISYPTSEVKGVIVHRLEAVSYNIGSQEWYTTVPRYIATNGYLISNFDDESSCVFVSESAICSQNSLYPMSPLLQQCIRGDTSSCARTLVSGTMGNKFILSKGNIVANCASILCKCYSTSTIINQSPDKLLTFIASDTCPLVEIDGATIQVGGRQYPDMVYEGKVALGPAISLDRLDVGTNLGNALKKLDDAKVLIDSSNQILETVRRSSFNFGSLLSVPILSCTALALLLLIYCCKRRYQQTLKQHTKVDPAFKPDLTGSKSYVRSL

SEQ ID NO: 1585 - protein, 444 aa, Human immunodeficiency virus type 1
FIGAIIGSVALGVATAAQITAASALIQANQNAANILRLKESITATIEAVIIEVTDGLSQLAVAVGKMQQFVNDQFNNTAQELDCIKTQQVGVELNLYLTELTTVFGPQITSPLTQLTIQALYNAGGNMDYLLTKLGVGNNQLSSLIGSGLITGNPILYSQTQLLGIQVTLPSVGNLNNMRATYLETLSVSTTKGFASALVPKVVTQVGSVIEELDTSYCIETDLDLYCTRIVTFPMSPGIYSCLNGNTSACMYSKTEGALTTPYMTLKGSVIANCKMTTCRCADPPGIISQNYGEAVSLIDRHSCNVLSLIDRHSCNVLSLDGITLRLSGEFDATYQKNISILDSVIVTGNLDISTELGNVNNSISNALDKLEESNSKLDKVNVKLTSTSALITYIALTAISLVCGILSLVLACYLMYKQKAQQKTLLWLGNNTLGQMRATTKM

SEQ ID NO: 1586 - protein, 434 aa, Human immunodeficiency virus type 1
FFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTPLLTRLLNTQIYRVDSISYNIQNREWYIPLPSHIMTKGAFLGGADVKECIEAFSSYICPSDPGFVLNHEMESCLSGNISQCPRTVVKSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESLEWIRRSNQKLDISGNWHQSSTTIIIVLIMIIILFIINVTIIIIAVKYYRIQKRNRVDQNDKPYVLTNK

SEQ ID NO: 1587 - protein, 219 aa, Human immunodeficiency virus type 1
GLFGAIAGFIENGWEGMIDGWYFRHQNSEGTGQAADLKSTQAAIDQNGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1588 - protein, 247 aa, Human immunodeficiency virus type 1
  VARIANT 27, 28, 29, 30, 158, 159, 160, 161, 162, 163, 164, 165, 166,167, 168, 169, 170, 171, 172, 173, 174, 175, 176, 177, 178,179, 180, 181, 182, 183, 184, 210: Xaa = Any Amino Acid
RNKRGVFVLGFLGFLATAGSAMGAASXXXXAQSRTLLAGIVQQQQQLLDVVKRQQELLRLTVWGTKNLQTRVTAIEKYLKDQAQLNAWGCAFRQVCHTVPWPNASLTPDWNNDTWQEWERKVDFLEENITALLEEAQIQQEKNMYELQLNSWDVFGNXXXXXXXXXXXXXXXXXXXXXXXXXXXIYIVMLAKLRQGYRPVFSSPPSYFQXTHTQQDPALPTREGKEGDGGEGGGNSSWPWQIEYIHF

SEQ ID NO: 1589 - protein, 854 aa, Human immunodeficiency virus type 1
MTRRRVLSVVVLLAALACRLGAQTPEQPAPPATTVQPTATRQQTSFPFRVCELSSHGDLFRFSSDIQCPSFGTRENHTEGLLMVFKDNIIPYSFKVRSYTKIVTNILIYNGWYADSVTNRHEEKFSVDSYETDQMDTIYQCYNAVKMTKDGLTRVYVDRDGVNITVNLKPTGGLANGVRRYASQTELYDAPGWLIWTYRTRTTVNCLITDMMAKSNSPFDFFVTTTGQTVEMSPFYDGKNKETFHERADSFHVRTNYKIVDYDNRGTNPQGERRAFLDKGTYTLSWKLENRTAYCPLQHWQTFDSTIATETGKSIHFVTDEGTSSFVTNTTVGIELPDAFKCIEEQVNKTHEKYEAVQDRYTKGQEAITYFITSGGLLLAWLPLTPRSLATVKNLTELTTPTSSPPSSPSPPAPSAARGSTPAAVLRRRRRDAGNATTPVPPTAPGKSLGTLNNPATVQIQFAYDSLRRQINRMLGDLARAWCLEQKRQNMVLRELTKINPTTVMSSIYGKAVAAKRLGDVISVSQCVPVNQATVLRKSMRVPGSETMCYSRPLVSFSFINDTKTYEGQLGTDNEIFLTKKMTEVCQATSQYYFQSGNEIHVYNDYHHFKTIELDGIATLQTFISNTSLIENIDFASLELYSRDEQRASNVFDLEGIFREYNFQAQNIAGLRKDLDNAVSNGRNQFVDGLGELMDSLGSVGQSITNLVSTVGGLFSSLVSGFISFFKNPFGGMLILVLVAGVVILVISLTRRTRQMSQQPVQMLYPGIDELAQQHASGEGPGINPISKTELQAIMLALHEQNQEQKRAAQRAAGPSVASRALQAARDRFPGLRRRRYHDPETAAALLGEAETEF

SEQ ID NO: 1590 - protein, 246 aa, Human immunodeficiency virus type 1
MMDPNSTSEDVKFTPDPYQVPFVQAFDQATRVQDLGGSPSQAPLPCVLWPVLPEPLPQGQLTAYHVSTAPTGSWFSAPQPAPENAYQAYAAPQLFPVSDITQNQQTNQAGGEAPQPGDNSTVQTAAAVVFACPGANQGQQLADIGVPQPAPVAAPARRTRKPQQPESLEECDSELEIKRYKNRVASRKCRAKFKQLLQHYRECVAAAKSSENDRLRLLLKQMCPSLDVDSIIPRTPDVLHEDLLNF

SEQ ID NO: 1591 - protein, 437 aa, Human immunodeficiency virus type 1
FAGVVLAGAALGVATAAQITAGIALHQSMLNSQAIDNLRASLETTNQAIEAIRAGQEMILAVQGVQDYINNELIPSMNQLSCDLIGQKLGLKLLRYYTEILSLFGPSLRDPISAEISIQLSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGEQVGMSRPGLKPDLTGTSKSYVRSL

SEQ ID NO: 1592 - protein, 387 aa, Human immunodeficiency virus type 1
MGQNLSTSNPLGFFPDHQLDPAFRANTANPDWDFNPNKDTWPDANKVGAGAFGLGFTPPHGGLLGWSPQAQGILQTLPANPPPASTNRQSGRQPTPLSPPLRNTHPQAMQWNSTTFHQTLQDPRVRGLYFPAGGSSSGTVNPVLTTASPLSSIFSRIGDPALNMENITSGFLGPLLVLQAGFFLLTRILTIPQSLDSWWTSLNFLGGTTVCLGQNSQSPTSNHPTSCPPTCPGYRMCLRRFIIFLFILLLCLIFLLVLLDYQGMLPVCPLIPGSSTTSTGPCRTCMTTAQGTSMYPSCCCTKPSDGNCTCIPIPSSWAFGKFLWEWASARFSWLSLLVPFVQWFVGLSPTVWLSVIWMMWYWGPSLYSILSPFLPLLPIFFCLWVYI

SEQ ID NO: 1593 - protein, 191 aa, Human immunodeficiency virus type 1
AIQLIPLFVGLGITTAVSTGAAGLGVSITQYTKLSHQLISDVQAISSTIQDLQDSLAEVVLQNRRGLDLLTAEQGGICLALQEKCCFYANKSGIVRDKIKNLQDDLERRRRQLIDNPFWTSFHGFLPYVMPLLGPLLCLLLLVLSFGPIIFNKLMTFIKHQIESIQAKPIQVHYIIRLEQEDSGGSYLTLT

SEQ ID NO: 1594 - protein, 125 aa, Human immunodeficiency virus type 1
YQDYTARTQVTTRAVSEVSALKTAAESAILEGKEIVSSATPKDTQYDIGFTESTLLDGSGKSQIQVTDNQDGTVELVATLGKSSGSAIKGAVITSRKNDGVWNCKITKTPTAWKPNYAPANCPKS

SEQ ID NO: 1595 - protein, 166 aa, Human immunodeficiency virus type 1
MNTLQKGFTLIELMIVIAIVGILAAVALPAYQDYTARAQVSEAILLAEGQKSAVTEYYLNHGIWPKDNTSAGVASSSSIKGKYVKEVKVENGVVTATMNSSNVNKEIQGKKLSLWAKRQDGSVKWFCGQPVTRNAKDDTVTADATGNDKIDTKHLPSTCRDNFDAS

SEQ ID NO: 1596 - protein, 212 aa, Human immunodeficiency virus type 1
MKKTLLGSLILLAFAGNVQADINTETSGKVTFFGKVVENTCKVTEHKNLSVVLNDVGKNSLSTKVNTAMPTPFTITLQNCDPTTANGTANKANKVGLYFYSWKNVDKENNFTLKNEQTTADYATNVNIQLMESNGTKAISVVGKETEDFMHTNNNGVALNQTHPNNAHISGSTQLTTGTNELPLHFIAQYYATNKATAGKVQSSVDFQIAYE

SEQ ID NO: 1597 - protein, 229 aa, Human immunodeficiency virus type 1
MNKKLLMNFFIVSPLLLATTATDFTPVPLSSQHKTASTNDNIKDLLDWYSSGSDTFTNSEVLDNSLGSMRIKNTDGSISLHFPSPYYSPAFTKGEKVDLNTKRTKKSQHTSEGTYIHFQISGVTNTEKLPTPIELPLKVKVHGKDSPLKYGPKFDKKQLAISTLDFEIRHQLTQIHGLYRSSDKTGGYWKITMNDGSTYQSDLSKKFEYNTEKPPINIDEIKTIEAEIN

SEQ ID NO: 1598 - protein, 254 aa, Human immunodeficiency virus type 1
MKKTAFILLLFIALTLTTSPLSEKSEEINEKDLRKKSELQRNALSNLRQIYYYNEKAITENKESDDQFLENTLLFKGFFTGHPWYNDLLVDLGSKDATNKYKGKKVDLYGAYYGYQCAGGTPNKATCMYGGVTLHDNNRLTEEKKVPINLWIDKQTTVPIDKVKTSKKEVTVQELDLQARHYLHGKFGLYNSDSFGGKVQRGLIVFHSSEGSSTVSYDLFDAQGQYPDTLLRIYRDNKTINSENLHIDLYLYTT

SEQ ID NO: 1599 - protein, 252 aa, Human immunodeficiency virus type 1
MKKTAFTLLLFIALTLTTSPLVNGSEKSEEINEKDLRKKSELQGTALGNLKQIYYYNEKAKTENKESHDQFLQHTILFKGFFTDHSWYNDLLVDFDSKIVDKYKKCDYGAYYGYQCAGGTPNKTACMYGGVTLHDNNRLTEEKKVPINLWLDGKQNTVPLETVKTNKKNVTVQELDQARRYLQEKNLYNSDVFDGKVQRGLIVFHTSTEPSVNYDLFGAGQGQYSNTLLRIYRDNKTINSENMHIDIYLYTS

SEQ ID NO: 1600 - protein, 259 aa, Human immunodeficiency virus type 1
MKNITFIFFILLASPLYANGDRLYRADSRPPDEIKRFRSLMPRGNEYFDRGTQMNINLYDHARGTQTGFFVRYDDGYVSTSLSSLRSAHLAGQYILSGYSLTIYIVIANMFNVNDVISVYSPHPYHPYEQEVSALGGIPYSQIYGWYRVNFGVIDERLHRNREYRDRYYRNLNIAPAEDGYRLAGFPPDHQAWREEPWIHHAPQGCGDSSRTITGDTCNEETQNLSTIYLREYQSKVKRQIFSDYQSEVDIYNRIRDEL

SEQ ID NO: 1601 - protein, 340 aa, Human immunodeficiency virus type 1
MMFSGFFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDPSVEPVKSISSMELKTEPFDDFLFPASSRPSGSETARSVPDMDLSGSFYAGSSSNEPSSDSLSSPTLLAL

SEQ ID NO: 1602 - protein, 563 aa, Human immunodeficiency virus type 1
SGWESYYKTEGDEEAEEAEEEQEENLEASGDYKYSGRDSLIFLVDASKAMFESQSEDELTPFDMSIQCIQSBYISKIISSDRDLLAVVFYGTEKDKNSSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLGFKPLVLLKKHHLRPFVYPEESLVIGSSTLFSALLIKCLEKEVAACRYTPRRNIPPYFVALVPQEEELDDQKIQVTPPGFQLVFLFADDKRKMPTFEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGKKQELLEALTKHFQD

SEQ ID NO: 1603 - protein, 427 aa, Human immunodeficiency virus type 1
GGGALSPQHSAVTQGSKIIKNKEGMDAKSMLENYKNLVSLGYQLTKPDVILRLEKGEEPWLVEREIHQETHPDSETAFEIKSSVSSSIFKDKQSCDIKMEGMARNDLWYLSLEEVWKCRDQLDKYQENPERHLRHQLIHTGEKPYECKECGKSFSRSSHLIGHQKTHTGEEPYECKECGKSFSWFSHLVTHQRTHTGDKLYTCNQCGKSFVHSSRLIRHQRTHTGHKPYECPECGKSFRQSTHLILHQRTHVRVRPYECNECGKSYSQRSHLVVHHRIHTGLKPFECDCGKCFRSSHLYSHQRTHTGEKPYECHDDCGKSFSQSSAKIVHQRIHTGEKPYECCQCGKAFIRKNDLIKHQRIHQRIHVGAETYKCNQCGIIFSQNSPFIVHQIAHTGEQFLTCGNQCGTALVNTSLIGQTNHIRENAY

SEQ ID NO: 1604 - protein, 47 aa, Human immunodeficiency virus type 1
PLLVLQAGFFLLTRILTIPQSLDSWWTSLNFLGGGTTVCLGQNSQSP

SEQ ID NO: 1605 - protein, 35 aa, Human immunodeficiency virus type 1; identical to SEQ ID NO: 482

SEQ ID NO: 1606 - protein, 35 aa, Human immunodeficiency virus type 1; identical to SEQ ID NO: 483

SEQ ID NO: 1607 - protein, 35 aa, Human immunodeficiency virus type 1; identical to SEQ ID NO: 484

SEQ ID NO: 1608 - protein, 35 aa, Human immunodeficiency virus type 1; identical to SEQ ID NO: 485

SEQ ID NO: 1609 - protein, 35 aa, Human immunodeficiency virus type 1; identical to SEQ ID NO: 486

SEQ ID NO: 1610 - protein, 35 aa, Human immunodeficiency virus type 1; identical to SEQ ID NO: 487

SEQ ID NO: 1611 - protein, 35 aa, Human immunodeficiency virus type 1; identical to SEQ ID NO: 488

SEQ ID NO: 1612 - protein, 35 aa, Human immunodeficiency virus type 1; identical to SEQ ID NO: 489

SEQ ID NO: 1613 - protein, 35 aa, Human immunodeficiency virus type 1; identical to SEQ ID NO: 490

SEQ ID NO: 1614 - protein, 35 aa, Human immunodeficiency virus type 1; identical to SEQ ID NO: 491

SEQ ID NO: 1615 - protein, 35 aa, Human immunodeficiency virus type 1; identical to SEQ ID NO: 492

SEQ ID NO: 1616 - protein, 58 aa, Human immunodeficiency virus type 1
PGYRWMCLRRFIIFLFILLLCLIFLLVLLDYQGMLPVCPLIPGSSTTSTGPCRTCMTT

SEQ ID NO: 1617 - protein, 35 aa, Human immunodeficiency virus type 1; identical to SEQ ID NO: 458

SEQ ID NO: 1618 - protein, 35 aa, Human immunodeficiency virus type 1; identical to SEQ ID NO: 459

SEQ ID NO: 1619 - protein, 35 aa, Human immunodeficiency virus type 1; identical to SEQ ID NO: 460

SEQ ID NO: 1620 - protein, 35 aa, Human immunodeficiency virus type 1; identical to SEQ ID NO: 461

SEQ ID NO: 1621 - protein, 35 aa, Human immunodeficiency virus type 1; identical to SEQ ID NO: 462

SEQ ID NO: 1622 - protein, 35 aa, Human immunodeficiency virus type 1; identical to SEQ ID NO: 463

SEQ ID NO: 1623 - protein, 35 aa, Human immunodeficiency virus type 1; identical to SEQ ID NO: 464

SEQ ID NO: 1624 - protein, 35 aa, Human immunodeficiency virus type 1; identical to SEQ ID NO: 465

SEQ ID NO: 1625 - protein, 35 aa, Human immunodeficiency virus type 1; identical to SEQ ID NO: 466

SEQ ID NO: 1626 - protein, 35 aa, Human immunodeficiency virus type 1; identical to SEQ ID NO: 467

SEQ ID NO: 1627 - protein, 35 aa, Human immunodeficiency virus type 1; identical to SEQ ID NO: 468

SEQ ID NO: 1628 - protein, 35 aa, Human immunodeficiency virus type 1; identical to SEQ ID NO: 469

SEQ ID NO: 1629 - protein, 35 aa, Human immunodeficiency virus type 1
IFLFILLLCLIFLLVLLDYQGMLPVCPLIPGSSTS

SEQ ID NO: 1630 - protein, 35 aa, Human immunodeficiency virus type 1
FLFILLLCLIFLLVLLDYQGMLPVCPLIPGSSTST

SEQ ID NO: 1631 - protein, 35 aa, Human immunodeficiency virus type 1
LFILLLCLIFLLVLLDYQGMLPVCPLIPGSSTSTG

SEQ ID NO: 1632 - protein, 35 aa, Human immunodeficiency virus type 1
FILLLCLIFLLVLLDYQGMLPVCPLIPGSSTSTGP

SEQ ID NO: 1633 - protein, 35 aa, Human immunodeficiency virus type 1
ILLLCLIFLLVLLDYQGMLPVCPLIPGSSTSTGPC

SEQ ID NO: 1634 - protein, 35 aa, Human immunodeficiency virus type 1
LLLCLIFLLVLLDYQGMLPVCPLIPGSSTSTGPCR

SEQ ID NO: 1635 - protein, 35 aa, Human immunodeficiency virus type 1
LLCLIFLLVLLDYQGMLPVCPLIPGSSTSTGPCRT

SEQ ID NO: 1636 - protein, 35 aa, Human immunodeficiency virus type 1
LCLIFLLVLLDYQGMLPVCPLIPGSSTSTGPCRTC

SEQ ID NO: 1637 - protein, 35 aa, Human immunodeficiency virus type 1
CLIFLLVLLDYQGMLPVCPLIPGSSTSTGPCRTCM

SEQ ID NO: 1638 - protein, 35 aa, Human immunodeficiency virus type 1
LIFLLVLLDYQGMLPVCPLIPGSSTSTGPCRTCMT

SEQ ID NO: 1639 - protein, 35 aa, Human immunodeficiency virus type 1
IFLLVLLDYQGMLPVCPLIPGSSTSTGPCRTCMTT

SEQ ID NO: 1640 - DNA, 21 bp, Artificial Sequence
  Description of Artificial Sequence: Primer
atgacgctgacggtacaggcc

SEQ ID NO: 1641 - DNA, 33 bp, Artificial Sequence
  Description of Artificial Sequence: Primer
tgactaagcttaataccacagccaatttgttat

SEQ ID NO: 1642 - DNA, 22 bp, Artificial Sequence
  Description of Artificial Sequence: Primer
ggagctgcttggggccccagac

SEQ ID NO: 1643 - DNA, 40 bp, Artificial Sequence
  Description of Artificial Sequence: Primer
ccaaatccccaggagctgctcgagctgcactataccagac

SEQ ID NO: 1644 - DNA, 35 bp, Artificial Sequence
  Description of Artificial Sequence: Primer
atagcttctagattaattgttaatttctctgtccc

SEQ ID NO: 1645 - protein, 35 aa, Rous sarcoma virus; identical to SEQ ID NO: 108

SEQ ID NO: 1646 - protein, 29 aa, Artificial Sequence
  Description of Artificial Sequence: T67
DEFDASISIQVNEKINQSLAFIRKSDELL

SEQ ID NO: 1647 - protein, 35 aa, Artificial Sequence
  Description of Artificial Sequence:T786
VYPSDEFDASISQVNEKINQALAYIRKADELLHNV

SEQ ID NO: 1648 - protein, 37 aa, Artificial Sequence
  Description of Artificial Sequence:T764
GSTMGARSMTLTVQARQLLSGIVQQNNLLRAIEAQQH

SEQ ID NO: 1649 - protein, 495 aa, Artificial Sequence
  fusion protein of malE and M41(delta)178
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTQARQLLSGIVQQQNNLLRAIEAQQHLLQLTVWGIKQLQARILAVERYLKDQQLLGIWGCSGKLICTTAVPWNASWSNKSLEQIWNNMTWMEWDREINNYTSLI

SEQ ID NO: 1650 - protein, 501 aa, Artificial Sequence
  fusion protein of malE and M41(delta)107
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTQARQLLSGIVQQQNNLLRWGCSGKLICTTAVPWNASWSNKSLEQIWNNMTWMEWDREINNYTSLIHSLIEESQNQQEKNEQELLELDKWASLWNWFNITNWLWYIKLFI

SEQ ID NO: 1651 - protein, 3 aa, Artificial Sequence
  core polypeptide
YTS

SEQ ID NO: 1652 - protein, 4 aa, Artificial Sequence
  core polypeptide
YTSL

SEQ ID NO: 1653 - protein, 5 aa, Artificial Sequence
  core polypeptide
YTSLI

SEQ ID NO: 1654 - protein, 6 aa, Artificial Sequence
  core polypeptide
YTSLIH

SEQ ID NO: 1655 - protein, 7 aa, Artificial Sequence
  core polypeptide
YTSLIHS

SEQ ID NO: 1656 - protein, 8 aa, Artificial Sequence
  core polypeptide
YTSLIHSL

SEQ ID NO: 1657 - protein, 9 aa, Artificial Sequence
  core polypeptide
YTSLIHSLI

SEQ ID NO: 1658 - protein, 10 aa, Artificial Sequence
  core polypeptide
YTSLIHSLIE

SEQ ID NO: 1659 - protein, 11 aa, Artificial Sequence
  core polypeptide
YTSLIHSLIEE

SEQ ID NO: 1660 - protein, 12 aa, Artificial Sequence
  core polypeptide
YTSLIHSLIEES

SEQ ID NO: 1661 - protein, 13 aa, Artificial Sequence
  core polypeptide
YTSLIHSLIEESQ

SEQ ID NO: 1662 - protein, 14 aa, Artificial Sequence
  core polypeptide
YTSLIHSLIEESQN

SEQ ID NO: 1663 - protein, 15 aa, Artificial Sequence
  core polypeptide
YTSLIHSLIEESQNQ

SEQ ID NO: 1664 - protein, 16 aa, Artificial Sequence
  core polypeptide
YTSLIHSLIEESQNQQ

SEQ ID NO: 1665 - protein, 17 aa, Artificial Sequence
  core polypeptide
YTSLIHSLIEESQNQQE

SEQ ID NO: 1666 - protein, 18 aa, Artificial Sequence
  core polypeptide
YTSLIHSLIEESQNQQEK

SEQ ID NO: 1667 - protein, 19 aa, Artificial Sequence
  core polypeptide
YTSLIHSLIEESQNQQEKN

SEQ ID NO: 1668 - protein, 20 aa, Artificial Sequence
  core polypeptide
YTSLIHSLIEESQNQQEKNE

SEQ ID NO: 1669 - protein, 21 aa, Artificial Sequence
  core polypeptide
YTSLIHSLIEESQNQQEKNEQ

SEQ ID NO: 1670 - protein, 22 aa, Artificial Sequence
  core polypeptide
YTSLIHSLIEESQNQQEKNEQE

SEQ ID NO: 1671 - protein, 23 aa, Artificial Sequence
  core polypeptide
YTSLIHSLIEESQNQQEKNEQEL

SEQ ID NO: 1672 - protein, 24 aa, Artificial Sequence
  core polypeptide
YTSLIHSLIEESQNQQEKNEQELL

SEQ ID NO: 1673 - protein, 25 aa, Artificial Sequence
  core polypeptide
YTSLIHSLIEESQNQQEKNEQELLE

SEQ ID NO: 1674 - protein, 26 aa, Artificial Sequence
  core polypeptide
YTSLIHSLIEESQNQQEKNEQELLEL

SEQ ID NO: 1675 - protein, 27 aa, Artificial Sequence
  core polypeptide
YTSLIHSLIEESQNQQEKNEQELLELD

SEQ ID NO: 1676 - protein, 28 aa, Artificial Sequence
  core polypeptide
YTSLIHSLIEESQNQQEKNEQELLELDK

SEQ ID NO: 1677 - protein, 29 aa, Artificial Sequence
  core polypeptide
YTSLIHSLIEESQNQQEKNEQELLELDKW

SEQ ID NO: 1678 - protein, 30 aa, Artificial Sequence; identical to SEQ ID NO: 907
  core polypeptide

SEQ ID NO: 1679 - protein, 31 aa, Artificial Sequence; identical to SEQ ID NO: 744
  core polypeptide

SEQ ID NO: 1680 - protein, 32 aa, Artificial Sequence; identical to SEQ ID NO: 743
  core polypeptide

SEQ ID NO: 1681 - protein, 33 aa, Artificial Sequence; identical to SEQ ID NO: 742
  core polypeptide

SEQ ID NO: 1682 - protein, 34 aa, Artificial Sequence; identical to SEQ ID NO: 741
  core polypeptide

SEQ ID NO: 1683 - protein, 35 aa, Artificial Sequence; identical to SEQ ID NO: 795
  core polypeptide

SEQ ID NO: 1684 - protein, 36 aa, Artificial Sequence; identical to SEQ ID NO: 15
  core polypeptide

SEQ ID NO: 1685 - protein, 3 aa, Artificial Sequence
  core polypeptide
NWF

SEQ ID NO: 1686 - protein, 4 aa, Artificial Sequence
  core polypeptide
WNWF

SEQ ID NO: 1687 - protein, 5 aa, Artificial Sequence
  core polypeptide
LWNWF

SEQ ID NO: 1688 - protein, 6 aa, Artificial Sequence
  core polypeptide
SLWNWF

SEQ ID NO: 1689 - protein, 7 aa, Artificial Sequence
  core polypeptide
ASLWNWF

SEQ ID NO: 1690 - protein, 8 aa, Artificial Sequence
  core polypeptide
WASLWNWF

SEQ ID NO: 1691 - protein, 9 aa, Artificial Sequence
  core polypeptide
KWASLWNWF

SEQ ID NO: 1692 - protein, 10 aa, Artificial Sequence
  core polypeptide
DKWASLWNWF

SEQ ID NO: 1693 - protein, 11 aa, Artificial Sequence
  core polypeptide
LDKWASLWNWF

SEQ ID NO: 1694 - protein, 12 aa, Artificial Sequence
  core polypeptide
ELDKWASLWNWF

SEQ ID NO: 1695 - protein, 13 aa, Artificial Sequence
  core polypeptide
LELDKWASLWNWF

SEQ ID NO: 1696 - protein, 14 aa, Artificial Sequence
  core polypeptide
LLELDKWASLWNWF

SEQ ID NO: 1697 - protein, 15 aa, Artificial Sequence
  core polypeptide
ELLELDKWASLWNWF

SEQ ID NO: 1698 - protein, 16 aa, Artificial Sequence
  core polypeptide
QELLELDKWASLWNWF

SEQ ID NO: 1699 - protein, 17 aa, Artificial Sequence
  core polypeptide
EQELLELDKWASLWNWF

SEQ ID NO: 1700 - protein, 18 aa, Artificial Sequence
  core polypeptide
NEQELLELDKWASLWNWF

SEQ ID NO: 1701 - protein, 19 aa, Artificial Sequence
  core polypeptide
KNEQELLELDKWASLWNWF

SEQ ID NO: 1702 - protein, 20 aa, Artificial Sequence
  core polypeptide
EKNEQELLELDKWASLWNWF

SEQ ID NO: 1703 - protein, 21 aa, Artificial Sequence
  core polypeptide
QEKNEQELLELDKWASLWNWF

SEQ ID NO: 1704 - protein, 22 aa, Artificial Sequence
  core polypeptide
QQEKNEQELLELDKWASLWNWF

SEQ ID NO: 1705 - protein, 23 aa, Artificial Sequence
  core polypeptide
NQQEKNEQELLELDKWASLWNWF

SEQ ID NO: 1706 - protein, 24 aa, Artificial Sequence
  core polypeptide
QNQQEKNEQELLELDKWASLWNWF

SEQ ID NO: 1707 - protein, 25 aa, Artificial Sequence
  core polypeptide
SQNQQEKNEQELLELDKWASLWNWF

SEQ ID NO: 1708 - protein, 26 aa, Artificial Sequence
  core polypeptide
ESQNQQEKNEQELLELDKWASLWNWF

SEQ ID NO: 1709 - protein, 27 aa, Artificial Sequence
  core polypeptide
EESQNQQEKNEQELLELDKWASLWNWF

SEQ ID NO: 1710 - protein, 28 aa, Artificial Sequence
  core polypeptide
IEESQNQQEKNEQELLELDKWASLWNWF

SEQ ID NO: 1711 - protein, 29 aa, Artificial Sequence
  core polypeptide
LIEESQNQQEKNEQELLELDKWASLWNWF

SEQ ID NO: 1712 - protein, 30 aa, Artificial Sequence; identical to SEQ ID NO: 794
  core polypeptide

SEQ ID NO: 1713 - protein, 31 aa, Artificial Sequence; identical to SEQ ID NO: 641
  core polypeptide

SEQ ID NO: 1714 - protein, 32 aa, Artificial Sequence; identical to SEQ ID NO: 802
  core polypeptide

SEQ ID NO: 1715 - protein, 33 aa, Artificial Sequence; identical to SEQ ID NO: 61
  core polypeptide

SEQ ID NO: 1716 - protein, 34 aa, Artificial Sequence; identical to SEQ ID NO: 800
  core polypeptide

SEQ ID NO: 1717 - protein, 35 aa, Artificial Sequence; identical to SEQ ID NO: 638
  core polypeptide

SEQ ID NO: 1718 - protein, 36 aa, Artificial Sequence; identical to SEQ ID NO: 15
  core polypeptide

SEQ ID NO: 1719 - protein, 3 aa, Artificial Sequence
  core polypeptide
NNL

SEQ ID NO: 1720 - protein, 4 aa, Artificial Sequence
  core polypeptide
NNLL

SEQ ID NO: 1721 - protein, 5 aa, Artificial Sequence
  core polypeptide
NNLLR

SEQ ID NO: 1722 - protein, 6 aa, Artificial Sequence
  core polypeptide
NNLLRA

SEQ ID NO: 1723 - protein, 7 aa, Artificial Sequence
  core polypeptide
NNLLRAI

SEQ ID NO: 1724 - protein, 8 aa, Artificial Sequence
  core polypeptide
NNLLRAIE

SEQ ID NO: 1725 - protein, 9 aa, Artificial Sequence
  core polypeptide
NNLLRAIEA

SEQ ID NO: 1726 - protein, 10 aa, Artificial Sequence
  core polypeptide
NNLLRAIEAQ

SEQ ID NO: 1727 - protein, 11 aa, Artificial Sequence
  core polypeptide
NNLLRAIEAQQ

SEQ ID NO: 1728 - protein, 12 aa, Artificial Sequence
  core polypeptide
NNLLRAIEAQQH

SEQ ID NO: 1729 - protein, 13 aa, Artificial Sequence
  core polypeptide
NNLLRAIEAQQHL

SEQ ID NO: 1730 - protein, 14 aa, Artificial Sequence
  core polypeptide
NNLLRAIEAQQHLL

SEQ ID NO: 1731 - protein, 15 aa, Artificial Sequence
  core polypeptide
NNLLRAIEAQQHLLQ

SEQ ID NO: 1732 - protein, 16 aa, Artificial Sequence
  core polypeptide
NNLLRAIEAQQHLLQL

SEQ ID NO: 1733 - protein, 17 aa, Artificial Sequence
  core polypeptide
NNLLRAIEAQQHLLQLT

SEQ ID NO: 1734 - protein, 18 aa, Artificial Sequence
  core polypeptide
NNLLRAIEAQQHLLQLTV

SEQ ID NO: 1735 - protein, 19 aa, Artificial Sequence
  core polypeptide
NNLLRAIEAQQHLLQLTVW

SEQ ID NO: 1736 - protein, 20 aa, Artificial Sequence
  core polypeptide
NNLLRAIEAQQHLLQLTVWQ

SEQ ID NO: 1737 - protein, 21 aa, Artificial Sequence
  core polypeptide
NNLLRAIEAQQHLLQLTVWQI

SEQ ID NO: 1738 - protein, 22 aa, Artificial Sequence
  core polypeptide
NNLLRAIEAQQHLLQLTVWQIK

SEQ ID NO: 1739 - protein, 23 aa, Artificial Sequence
  core polypeptide
NNLLRAIEAQQHLLQLTVWQIKQ

SEQ ID NO: 1740 - protein, 24 aa, Artificial Sequence
  core polypeptide
NNLLRAIEAQQHLLQLTVWQIKQL

SEQ ID NO: 1741 - protein, 25 aa, Artificial Sequence
  core polypeptide
NNLLRAIEAQQHLLQLTVWQIKQLQ

SEQ ID NO: 1742 - protein, 26 aa, Artificial Sequence
  core polypeptide
NNLLRAIEAQQHLLQLTVWQIKQLQA

SEQ ID NO: 1743 - protein, 27 aa, Artificial Sequence
  core polypeptide
NNLLRAIEAQQHLLQLTVWQIKQLQAR

SEQ ID NO: 1744 - protein, 28 aa, Artificial Sequence
  core polypeptide
NNLLRAIEAQQHLLQLTVWQIKQLQARI

SEQ ID NO: 1745 - protein, 29 aa, Artificial Sequence
  core polypeptide
NNLLRAIEAQQHLLQLTVWQIKQLQARIL

SEQ ID NO: 1746 - protein, 30 aa, Artificial Sequence
  core polypeptide
NNLLRAIEAQQHLLQLTVWQIKQLQARILA

SEQ ID NO: 1747 - protein, 31 aa, Artificial Sequence
  core polypeptide
NNLLRAIEAQQHLLQLTVWQIKQLQARILAV

SEQ ID NO: 1748 - protein, 32 aa, Artificial Sequence
  core polypeptide
NNLLRAIEAQQHLLQLTVWQIKQLQARILAVE

SEQ ID NO: 1749 - protein, 33 aa, Artificial Sequence
  core polypeptide
NNLLRAIEAQQHLLQLTVWQIKQLQARILAVER

SEQ ID NO: 1750 - protein, 34 aa, Artificial Sequence
  core polypeptide
NNLLRAIEAQQHLLQLTVWQIKQLQARILAVERY

SEQ ID NO: 1751 - protein, 35 aa, Artificial Sequence
  core polypeptide
NNLLRAIEAQQHLLQLTVWQIKQLQARILAVERYL

SEQ ID NO: 1752 - protein, 36 aa, Artificial Sequence
  core polypeptide
NNLLRAIEAQQHLLQLTVWQIKQLQARILAVERYLK

SEQ ID NO: 1753 - protein, 37 aa, Artificial Sequence
  core polypeptide
NNLLRAIEAQQHLLQLTVWQIKQLQARILAVERYLKD

SEQ ID NO: 1754 - protein, 38 aa, Artificial Sequence; identical to SEQ ID NO: 1548
  core polypeptide

SEQ ID NO: 1755 - protein, 3 aa, Artificial Sequence
  core polypeptide
KDQ

SEQ ID NO: 1756 - protein, 4 aa, Artificial Sequence
  core polypeptide
LKDQ

SEQ ID NO: 1757 - protein, 5 aa, Artificial Sequence
  core polypeptide
YLKDQ

SEQ ID NO: 1758 - protein, 6 aa, Artificial Sequence
  core polypeptide
RYLKDQ

SEQ ID NO: 1759 - protein, 7 aa, Artificial Sequence
  core polypeptide
ERYLKDQ

SEQ ID NO: 1760 - protein, 8 aa, Artificial Sequence
  core polypeptide
VERYLKDQ

SEQ ID NO: 1761 - protein, 9 aa, Artificial Sequence
  core polypeptide
AVERYLKDQ

SEQ ID NO: 1762 - protein, 10 aa, Artificial Sequence
  core polypeptide
LAVERYLKDQ

SEQ ID NO: 1763 - protein, 11 aa, Artificial Sequence
  core polypeptide
ILAVERYLKDQ

SEQ ID NO: 1764 - protein, 12 aa, Artificial Sequence
  core polypeptide
RILAVERYLKDQ

SEQ ID NO: 1765 - protein, 13 aa, Artificial Sequence
  core polypeptide
ARILAVERYLKDQ

SEQ ID NO: 1766 - protein, 14 aa, Artificial Sequence
  core polypeptide
QARILAVERYLKDQ

SEQ ID NO: 1767 - protein, 15 aa, Artificial Sequence
  core polypeptide
LQARILAVERYLKDQ

SEQ ID NO: 1768 - protein, 16 aa, Artificial Sequence
  core polypeptide
QLQARILAVERYLKDQ

SEQ ID NO: 1769 - protein, 17 aa, Artificial Sequence
  core polypeptide
KQLQARILAVERYLKDQ

SEQ ID NO: 1770 - protein, 18 aa, Artificial Sequence
  core polypeptide
IKQLQARILAVERYLKDQ

SEQ ID NO: 1771 - protein, 19 aa, Artificial Sequence
  core polypeptide
QIKQLQARILAVERYLKDQ

SEQ ID NO: 1772 - protein, 20 aa, Artificial Sequence
  core polypeptide
WQIKQLQARILAVERYLKDQ

SEQ ID NO: 1773 - protein, 21 aa, Artificial Sequence
  core polypeptide
VWQIKQLQARILAVERYLKDQ

SEQ ID NO: 1774 - protein, 22 aa, Artificial Sequence
  core polypeptide
TVWQIKQLQARILAVERYLKDQ

SEQ ID NO: 1775 - protein, 23 aa, Artificial Sequence
  core polypeptide
LTVWQIKQLQARILAVERYLKDQ

SEQ ID NO: 1776 - protein, 24 aa, Artificial Sequence
  core polypeptide
QLTVWQIKQLQARILAVERYLKDQ

SEQ ID NO: 1777 - protein, 25 aa, Artificial Sequence
  core polypeptide
LQLTVWQIKQLQARILAVERYLKDQ

SEQ ID NO: 1778 - protein, 26 aa, Artificial Sequence
  core polypeptide
LLQLTVWQIKQLQARILAVERYLKDQ

SEQ ID NO: 1779 - protein, 27 aa, Artificial Sequence
  core polypeptide
HLLQLTVWQIKQLQARILAVERYLKDQ

SEQ ID NO: 1780 - protein, 28 aa, Artificial Sequence
  core polypeptide
QHLLQLTVWQIKQLQARILAVERYLKDQ

SEQ ID NO: 1781 - protein, 29 aa, Artificial Sequence
  core polypeptide
QQHLLQLTVWQIKQLQARILAVERYLKDQ

SEQ ID NO: 1782 - protein, 30 aa, Artificial Sequence
  core polypeptide
AQQHLLQLTVWQIKQLQARILAVERYLKDQ

SEQ ID NO: 1783 - protein, 31 aa, Artificial Sequence
  core polypeptide
EAQQHLLQLTVWQIKQLQARILAVERYLKDQ

SEQ ID NO: 1784 - protein, 32 aa, Artificial Sequence
  core polypeptide
IEAQQHLLQLTVWQIKQLQARILAVERYLKDQ

SEQ ID NO: 1785 - protein, 33 aa, Artificial Sequence
  core polypeptide
AIEAQQHLLQLTVWQIKQLQARILAVERYLKDQ

SEQ ID NO: 1786 - protein, 34 aa, Artificial Sequence
  core polypeptide
RAIEAQQHLLQLTVWQIKQLQARILAVERYLKDQ

SEQ ID NO: 1787 - protein, 35 aa, Artificial Sequence
  core polypeptide
LRAIEAQQHLLQLTVWQIKQLQARILAVERYLKDQ

SEQ ID NO: 1788 - protein, 36 aa, Artificial Sequence
  core polypeptide
LLRAIEAQQHLLQLTVWQIKQLQARILAVERYLKDQ

SEQ ID NO: 1789 - protein, 37 aa, Artificial Sequence
  core polypeptide
NLLRAIEAQQHLLQLTVWQIKQLQARILAVERYLKDQ

SEQ ID NO: 1790 - protein, 38 aa, Artificial Sequence; identical to SEQ ID NO: 1548
  core polypeptide

SEQ ID NO: 1791 - protein, 3 aa, Artificial Sequence
  core polypeptide
LEA

SEQ ID NO: 1792 - protein, 4 aa, Artificial Sequence
  core polypeptide
LEAN

SEQ ID NO: 1793 - protein, 5 aa, Artificial Sequence
  core polypeptide
LEANI

SEQ ID NO: 1794 - protein, 6 aa, Artificial Sequence
  core polypeptide
LEANIS

SEQ ID NO: 1795 - protein, 7 aa, Artificial Sequence
  core polypeptide
LEANISQ

SEQ ID NO: 1796 - protein, 8 aa, Artificial Sequence
  core polypeptide
LEANISQS

SEQ ID NO: 1797 - protein, 9 aa, Artificial Sequence
  core polypeptide
LEANISQSL

SEQ ID NO: 1798 - protein, 10 aa, Artificial Sequence
  core polypeptide
LEANISQSLE

SEQ ID NO: 1799 - protein, 11 aa, Artificial Sequence
  core polypeptide
LEANISQSLEQ

SEQ ID NO: 1800 - protein, 12 aa, Artificial Sequence
  core polypeptide
LEANISQSLEQA

SEQ ID NO: 1801 - protein, 13 aa, Artificial Sequence
  core polypeptide
LEANISQSLEQAQ

SEQ ID NO: 1802 - protein, 14 aa, Artificial Sequence
  core polypeptide
LEANISQSLEQAQI

SEQ ID NO: 1803 - protein, 15 aa, Artificial Sequence
  core polypeptide
LEANISQSLEQAQIQ

SEQ ID NO: 1804 - protein, 16 aa, Artificial Sequence
  core polypeptide
LEANISQSLEQAQIQQ

SEQ ID NO: 1805 - protein, 17 aa, Artificial Sequence
  core polypeptide
LEANISQSLEQAQIQQE

SEQ ID NO: 1806 - protein, 18 aa, Artificial Sequence
  core polypeptide
LEANISQSLEQAQIQQEK

SEQ ID NO: 1807 - protein, 19 aa, Artificial Sequence
  core polypeptide
LEANISQSLEQAQIQQEKN

SEQ ID NO: 1808 - protein, 20 aa, Artificial Sequence
  core polypeptide
LEANISQSLEQAQIQQEKNM

SEQ ID NO: 1809 - protein, 21 aa, Artificial Sequence
  core polypeptide
LEANISQSLEQAQIQQEKNMY

SEQ ID NO: 1810 - protein, 22 aa, Artificial Sequence
  core polypeptide
LEANISQSLEQAQIQQEKNMYE

SEQ ID NO: 1811 - protein, 23 aa, Artificial Sequence
  core polypeptide
LEANISQSLEQAQIQQEKNMYEL

SEQ ID NO: 1812 - protein, 24 aa, Artificial Sequence
  core polypeptide
LEANISQSLEQAQIQQEKNMYELQ

SEQ ID NO: 1813 - protein, 25 aa, Artificial Sequence
  core polypeptide
LEANISQSLEQAQIQQEKNMYELQK

SEQ ID NO: 1814 - protein, 26 aa, Artificial Sequence
  core polypeptide
LEANISQSLEQAQIQQEKNMYELQKL

SEQ ID NO: 1815 - protein, 27 aa, Artificial Sequence
  core polypeptide
LEANISQSLEQAQIQQEKNMYELQKLN

SEQ ID NO: 1816 - protein, 28 aa, Artificial Sequence
  core polypeptide
LEANISQSLEQAQIQQEKNMYELQKLNS

SEQ ID NO: 1817 - protein, 29 aa, Artificial Sequence
  core polypeptide
LEANISQSLEQAQIQQEKNMYELQKLNSW

SEQ ID NO: 1818 - protein, 30 aa, Artificial Sequence
  core polypeptide
LEANISQSLEQAQIQQEKNMYELQKLNSWD

SEQ ID NO: 1819 - protein, 31 aa, Artificial Sequence
  core polypeptide
LEANISQSLEQAQIQQEKNMYELQKLNSWDV

SEQ ID NO: 1820 - protein, 32 aa, Artificial Sequence
  core polypeptide
LEANISQSLEQAQIQQEKNMYELQKLNSWDVF

SEQ ID NO: 1821 - protein, 33 aa, Artificial Sequence
  core polypeptide
LEANISQSLEQAQIQQEKNMYELQKLNSWDVFT

SEQ ID NO: 1822 - protein, 34 aa, Artificial Sequence
  core polypeptide
LEANISQSLEQAQIQQEKNMYELQKLNSWDVFTN

SEQ ID NO: 1823 - protein, 35 aa, Artificial Sequence
  core polypeptide
LEANISQSLEQAQIQQEKNMYELQKLNSWDVFTNW

SEQ ID NO: 1824 - protein, 36 aa, Artificial Sequence; identical to SEQ ID NO: 621
  core polypeptide

SEQ ID NO: 1825 - protein, 3 aa, Artificial Sequence
  core polypeptide
NWL

SEQ ID NO: 1826 - protein, 4 aa, Artificial Sequence
  core polypeptide
TNWL

SEQ ID NO: 1827 - protein, 5 aa, Artificial Sequence
  core polypeptide
FTNWL

SEQ ID NO: 1828 - protein, 6 aa, Artificial Sequence
  core polypeptide
VFTNWL

SEQ ID NO: 1829 - protein, 7 aa, Artificial Sequence
  core polypeptide
DVFTNWL

SEQ ID NO: 1830 - protein, 8 aa, Artificial Sequence
  core polypeptide
WDVFTNWL

SEQ ID NO: 1831 - protein, 9 aa, Artificial Sequence
  core polypeptide
SWDVFTNWL

SEQ ID NO: 1832 - protein, 10 aa, Artificial Sequence
  core polypeptide
NSWDVFTNWL

SEQ ID NO: 1833 - protein, 11 aa, Artificial Sequence
  core polypeptide
LNSWDVFTNWL

SEQ ID NO: 1834 - protein, 12 aa, Artificial Sequence
  core polypeptide
KLNSWDVFTNWL

SEQ ID NO: 1835 - protein, 13 aa, Artificial Sequence
  core polypeptide
QKLNSWDVFTNWL

SEQ ID NO: 1836 - protein, 14 aa, Artificial Sequence
  core polypeptide
LQKLNSWDVFTNWL

SEQ ID NO: 1837 - protein, 15 aa, Artificial Sequence
  core polypeptide
ELQKLNSWDVFTNWL

SEQ ID NO: 1838 - protein, 16 aa, Artificial Sequence
  core polypeptide
YELQKLNSWDVFTNWL

SEQ ID NO: 1839 - protein, 17 aa, Artificial Sequence
  core polypeptide
MYELQKLNSWDVFTNWL

SEQ ID NO: 1840 - protein, 18 aa, Artificial Sequence
  core polypeptide
NMYELQKLNSWDVFTNWL

SEQ ID NO: 1841 - protein, 19 aa, Artificial Sequence
  core polypeptide
KNMYELQKLNSWDVFTNWL

SEQ ID NO: 1842 - protein, 20 aa, Artificial Sequence
  core polypeptide
EKNMYELQKLNSWDVFTNWL

SEQ ID NO: 1843 - protein, 21 aa, Artificial Sequence
  core polypeptide
QEKNMYELQKLNSWDVFTNWL

SEQ ID NO: 1844 - protein, 22 aa, Artificial Sequence
  core polypeptide
QQEKNMYELQKLNSWDVFTNWL

SEQ ID NO: 1845 - protein, 23 aa, Artificial Sequence
  core polypeptide
IQQEKNMYELQKLNSWDVFTNWL

SEQ ID NO: 1846 - protein, 24 aa, Artificial Sequence
  core polypeptide
QIQQEKNMYELQKLNSWDVFTNWL

SEQ ID NO: 1847 - protein, 25 aa, Artificial Sequence
  core polypeptide
AQIQQEKNMYELQKLNSWDVFTNWL

SEQ ID NO: 1848 - protein, 26 aa, Artificial Sequence
  core polypeptide
QAQIQQEKNMYELQKLNSWDVFTNWL

SEQ ID NO: 1849 - protein, 27 aa, Artificial Sequence
  core polypeptide
EQAQIQQEKNMYELQKLNSWDVFTNWL

SEQ ID NO: 1850 - protein, 28 aa, Artificial Sequence
  core polypeptide
LEQAQIQQEKNMYELQKLNSWDVFTNWL

SEQ ID NO: 1851 - protein, 29 aa, Artificial Sequence
  core polypeptide
SLEQAQIQQEKNMYELQKLNSWDVFTNWL

SEQ ID NO: 1852 - protein, 30 aa, Artificial Sequence
  core polypeptide
QSLEQAQIQQEKNMYELQKLNSWDVFTNWL

SEQ ID NO: 1853 - protein, 31 aa, Artificial Sequence
  core polypeptide
SQSLEQAQIQQEKNMYELQKLNSWDVFTNWL

SEQ ID NO: 1854 - protein, 32 aa, Artificial Sequence
  core polypeptide
ISQSLEQAQIQQEKNMYELQKLNSWDVFTNWL

SEQ ID NO: 1855 - protein, 33 aa, Artificial Sequence
  core polypeptide
NISQSLEQAQIQQEKNMYELQKLNSWDVFTNWL

SEQ ID NO: 1856 - protein, 34 aa, Artificial Sequence
  core polypeptide
ANISQSLEQAQIQQEKNMYELQKLNSWDVFTNWL

SEQ ID NO: 1857 - protein, 35 aa, Artificial Sequence
  core polypeptide
EANISQSLEQAQIQQEKNMYELQKLNSWDVFTNWL

SEQ ID NO: 1858 - protein, 36 aa, Artificial Sequence; identical to SEQ ID NO: 621
  core polypeptide

SEQ ID NO: 1859 - protein, 34 aa, Artificial Sequence
  Core polypeptide
  SITE 17: Xaa = U (Aminobutyric Acid)
YTSVITIELSNIKENKXNGTDAVKLIKQELDKYK

SEQ ID NO: 1860 - protein, 34 aa, Artificial Sequence
  Core polypeptide
  SITE 16: Xaa = U (Aminobutyric Acid)
TSVITIELSNIKENKXNGTDAVKLIKQELDKYKN

SEQ ID NO: 1861 - protein, 34 aa, Artificial Sequence
  Core polypeptide
  SITE 15: Xaa = U (Aminobutyric Acid)
SVITIELSNIKENKXNGTDAVKLIKQELDKYKNA

SEQ ID NO: 1862 - protein, 35 aa, Artificial Sequence
  Core polypeptide
  SITE 8: Xaa = U (Aminobutyric Acid)
SNIKENKXNGTDAKVKLIKQELDKYKNAVTELQLL

SEQ ID NO: 1863 - protein, 35 aa, Artificial Sequence
  Core polypeptide
  SITE 5: Xaa = U (Aminobutyric Acid)
KENKXNGTDAKVKLIKQELDKYKNAVTELQLLMQS

SEQ ID NO: 1864 - protein, 35 aa, Artificial Sequence
  Core polypeptide
PPLVLQAGFFLLTRILTIPQSLDSWWTSLNFLGGT

SEQ ID NO: 1865 - protein, 36 aa, Artificial Sequence
  Core polypeptide
  SITE 31: Xaa = U (Aminobutyric Acid)
AVSKGYLSALRTGWYTSVITIELSNIKENKXNGTDA

SEQ ID NO: 1866 - protein, 35 aa, Artificial Sequence
  Core polypeptide
  SITE 33: Xaa = U (Aminobutyric Acid)
RAKFKQLLQHYREVAAAKSSENDRLRLLLKQMXPS

SEQ ID NO: 1867 - protein, 35 aa, Artificial Sequence
  Core polypeptide
  SITE 1, 5: Xaa = Abu (Aminobytyric acid)
XDDEXMNSVKNGTYDYPKYEEESKLNRNEIKGVKL

SEQ ID NO: 1868 - protein, 38 aa, Artificial Sequence
  Core polypeptide
  SITE 2: Xaa = Nle (Norleucine)
MXWMEWDREINNYTSLIHSLIEESQNQQEKNEQELLEL

SEQ ID NO: 1869 - protein, 36 aa, Artificial Sequence
  Core polypeptide
  SITE 2: Xaa = Nle (Norleucine)
WXEWDREINNYTSLIHSLIEESQNQQEKNEQELLEL

SEQ ID NO: 1870 - protein, 10 aa, Artificial Sequence
  Core polypeptide
  SITE 1, 2: Xaa = Aca (aminocaprioc acid)
XXIRKSDELL

SEQ ID NO: 1871 - protein, 36 aa, Artificial Sequence; identical to SEQ ID NO: 1869
  Core polypeptide
  SITE 2: Xaa = Nle (Norleucine)

SEQ ID NO: 1872 - protein, 35 aa, Artificial Sequence
  Core polypeptide
IDISIELNKAKSDLEEAKEWIDDANQKLDSIGNWH

SEQ ID NO: 1873 - protein, 25 aa, Artificial Sequence
  Core polypeptide
YDASISQVNEEINQALAFIRKADEL

SEQ ID NO: 1874 - protein, 26 aa, Artificial Sequence
  Core polypeptide
YDASISQVNEEINQSLAYIRKADELL

SEQ ID NO: 1875 - protein, 35 aa, Artificial Sequence
  Core polypeptide
IDISIELNKAKSDLEESKEWIEKSNQKLDSIGNWH

SEQ ID NO: 1876 - protein, 35 aa, Artificial Sequence
  Core polypeptide
VYPSDEYDASISQVNEKINQSLAYIRKSDELLHNV

SEQ ID NO: 1877 - protein, 35 aa, Artificial Sequence
  Core polypeptide
QWFVFLSPTVWLSVIWMMWYWGPSLYSILSPFLPL

SEQ ID NO: 1878 - protein, 28 aa, Artificial Sequence
  Core polypeptide
  SITE 16: Xaa = Abu (aminobutyric acid)
PTRVNYILIIGVLVLXEVTGVRADVHLL

SEQ ID NO: 1879 - protein, 35 aa, Artificial Sequence
  Core polypeptide
  SITE 16: Xaa = Abu (aminobutyric acid)
PTRVNYILIIGVLVLXEVTGVRADVHLLEQPGNLW

SEQ ID NO: 1880 - protein, 35 aa, Artificial Sequence
  Core polypeptide
  SITE 23: Xaa = Abu (aminobutyric acid)
PEKTPLLPTRVNYILIIGVLVLXEVTGVRADVHLL

SEQ ID NO: 1881 - protein, 39 aa, Artificial Sequence
  Core polypeptide
  SITE 1: Xaa = Aha
XGGGVYPSDEYDASISQVNEEINQALAYIRKADELLENV

SEQ ID NO: 1882 - protein, 11 aa, Artificial Sequence
  Core polypeptide
HWSYALALRPG

SEQ ID NO: 1883 - protein, 35 aa, Artificial Sequence
  Core polypeptide
  SITE 1, 2, 3, 32, 33, 34: Xaa = Aca (aminocaproic acid)
XXXDEFDESISQVNEKIEESLAFIRKSDELLXXXW

SEQ ID NO: 1884 - protein, 37 aa, Artificial Sequence
  Core polypeptide
  SITE 1, 2, 3, 34, 35, 36: Xaa = Aca (aminocaproic acid)
XXXGDEFDESISQVNEKIEESLAFIRKSDELLGXXXW

SEQ ID NO: 1885 - protein, 35 aa, Artificial Sequence
  Core polypeptide
  SITE 2: Xaa = Nal (napthylalanine)
VXPSDEYDASISQVNEEINQALAYIRKADELLENV

SEQ ID NO: 1886 - protein, 35 aa, Artificial Sequence
  Core polypeptide
  SITE 2, 7: Xaa = Nal (napthylalanine)
VXPSDEXDASISQVNEEINQALAYIRKADELLENV

SEQ ID NO: 1887 - protein, 35 aa, Artificial Sequence
  Core polypeptide
  SITE 2, 24: Xaa = Nal (napthylalanine)
VXPSDEYDASISQVNEEINQALAXIRKADELLENV

SEQ ID NO: 1888 - protein, 36 aa, Artificial Sequence; identical to SEQ ID NO: 1025
  Core polypeptide

SEQ ID NO: 1889 - protein, 28 aa, Artificial Sequence
  Core polypeptide
  SITE 1, 2, 3, 25, 26, 27: Xaa = Aua (11-aminoundecanoic acid)
XXXTALLEQAQIQQEKNEYELQKLXXXW

SEQ ID NO: 1890 - protein, 36 aa, Artificial Sequence
  Core polypeptide
WQAAEQKVRYLEANITALLEQAQIQQEKNEYELQKL

SEQ ID NO: 1891 - protein, 36 aa, Artificial Sequence
  Core polypeptide
WQEWEAAVRYLEANITALLEQAQIQQEKNEYELQKL

SEQ ID NO: 1892 - protein, 36 aa, Artificial Sequence
  Core polypeptide
WQEWEQAARYLEANITALLEQAQIQQEKNEYELQKL

SEQ ID NO: 1893 - protein, 36 aa, Artificial Sequence; identical to SEQ ID NO: 1033
  Core polypeptide

SEQ ID NO: 1894 - protein, 36 aa, Artificial Sequence; identical to SEQ ID NO: 1034
  Core polypeptide

SEQ ID NO: 1895 - protein, 47 aa, Artificial Sequence
  Core polypeptide
WQEWEQKVRYLEANITALLEQAQIQQEKNEYELQKLGGGGWASLWNF

SEQ ID NO: 1896 - protein, 39 aa, Artificial Sequence
  Core polypeptide
  SITE 6, 35: Xaa = Aca (aminocaproic acid)
GWNWFXDEFDESISQVQEEIEESLAFIEESDELLXWNWF

SEQ ID NO: 1897 - protein, 38 aa, Artificial Sequence
  Core polypeptide
  SITE 5, 34: Xaa = Aca (aminocaproic acid)
WNWFXDEFDESISQVNEKIEESLAFIRKSDELLXWNWF

SEQ ID NO: 1898 - protein, 38 aa, Artificial Sequence
  Core polypeptide
  SITE 5, 34: Xaa = Aca (aminocaproic acid)
WNWFXDEFDESISQVNEKIEESLAFIEESDELLXWNWF

SEQ ID NO: 1899 - protein, 35 aa, Artificial Sequence; identical to SEQ ID NO: 1099
  Core polypeptide

SEQ ID NO: 1900 - protein, 35 aa, Artificial Sequence; identical to SEQ ID NO: 1156
  Core polypeptide

SEQ ID NO: 1901 - protein, 35 aa, Artificial Sequence
  Core polypeptide
  SITE 11: Xaa = U (Aminobutyric Acid)
LSTTQWQVLPXSFTTLPALSTGLIHLHQNIVDVQY

SEQ ID NO: 1902 - protein, 33 aa, Artificial Sequence
  Core polypeptide
  SITE 12, 22: Xaa = U (Aminobutyric Acid)
FRKFPEATFSRXGSGPRITPRXMVDFPFRLWHY

SEQ ID NO: 1903 - protein, 39 aa, Artificial Sequence
  Core polypeptide
  SITE 11, 35: Xaa = U (Aminobutyric Acid)
DFPFRLWHFPXTINYTIFKVRLFVGGVEHRLEAAXNWTR

SEQ ID NO: 1904 - protein, 34 aa, Artificial Sequence
  Core polypeptide
  SITE 13, 21: Xaa = U (Aminobutyric Acid)
YVGGVEHRLEAAXNWTRGERXDLEDRDRSELSPL

SEQ ID NO: 1905 - protein, 27 aa, Artificial Sequence
  Core polypeptide
  SITE 3, 17, 24: Xaa = Any Amino Acid
YTXLIHSLIWESQNQQXKNEQELXELD

SEQ ID NO: 1906 - protein, 39 aa, Artificial Sequence
  Core polypeptide
  SITE 6, 13, 20, 27: Xaa = Any Amino Acid
WQEQEXKITALLXQAQIQQXKNEYELXKLDKWASLWEWF

SEQ ID NO: 1907 - protein, 30 aa, Artificial Sequence
  Core polypeptide
  SITE 6, 13, 20, 27: Xaa = Any Amino Acid
WQEWWXKITALLXQAQIQQXKNEYELXKLD

SEQ ID NO: 1908 - protein, 27 aa, Artificial Sequence
  Core polypeptide
  SITE 3, 10, 17, 24: Xaa = Any Amino Acid
WEXKITALLXQAQIQQXKNEYELXKLD

SEQ ID NO: 1909 - protein, 35 aa, Artificial Sequence
  Core polypeptide
STNKAVVSLSNGVSVGTSKVLDLKNYIDKQLLPIV

SEQ ID NO: 1910 - protein, 35 aa, Artificial Sequence
  Core polypeptide
  SITE 35: Xaa = U (Aminobutyric Acid)
VVSLSNGVSVLTSKVDLKNYIDKQWLLPIVNKQSX

SEQ ID NO: 1911 - protein, 35 aa, Artificial Sequence
  Core polypeptide
  SITE 34: Xaa = U (Aminobutyric Acid)
VSLSNGVSVLTSKVLDLKNYIDKQLLPIVNKQSXS

SEQ ID NO: 1912 - protein, 35 aa, Artificial Sequence
  Core polypeptide
  SITE 33: Xaa = U (Aminobutyric Acid)
SLSNGVSVLTSKVLDLKNYIDKQLLPIVNKQSXSI

SEQ ID NO: 1913 - protein, 36 aa, Artificial Sequence
  Core polypeptide
  SITE 33: Xaa = U (Aminobutyric Acid)
LSNGVSVLTSKVLDKLKNYIDKQLLPIVNKQSXSIS

SEQ ID NO: 1914 - protein, 35 aa, Artificial Sequence
  Core polypeptide
  SITE 31: Xaa = U (Aminobutyric Acid)
SNGVSVLTSKVLDLKNYIDKQLLPIVNKQSXSISN

SEQ ID NO: 1915 - protein, 35 aa, Artificial Sequence
  Core polypeptide
  SITE 30: Xaa = U (Aminobutyric Acid)
NGVSVLTSKVLDLKNYIDKQLLPIVNKQSXSISNI

SEQ ID NO: 1916 - protein, 35 aa, Artificial Sequence
  Core polypeptide
  SITE 29: Xaa = U (Aminobutyric Acid)
GVSVLTSKVLDLKNYIDKQLLPIVNKQSXSISNIE

SEQ ID NO: 1917 - protein, 36 aa, Artificial Sequence
  Core polypeptide
  SITE 28: Xaa = U (Aminobutyric Acid)
VSVLTSKVLDLKNYIDKQLLPIVNKQSXSISINIET

SEQ ID NO: 1918 - protein, 35 aa, Artificial Sequence
  Core polypeptide
  SITE 27: Xaa = U (Aminobutyric Acid)
SVLTSKVLDLKNYIDKQLLPIVNKQSXSISNIETV

SEQ ID NO: 1919 - protein, 35 aa, Artificial Sequence
  Core polypeptide
  SITE 26: Xaa = U (Aminobutyric Acid)
VLTSKVLDLKNYIDKQLLPIVNKQSXSISNIETVI

SEQ ID NO: 1920 - protein, 35 aa, Artificial Sequence
  Core polypeptide
  SITE 25: Xaa = U (Aminobutyric Acid)
LTSKVLDLKNYIDKQLLPIVNKQSXSISNIETVIE

SEQ ID NO: 1921 - protein, 34 aa, Artificial Sequence
  Core polypeptide
  SITE 23: Xaa = U (Aminobutyric Acid)
TSKVLDLKNYIDKQLLPIVKQSXSISNIETVIEF

SEQ ID NO: 1922 - protein, 35 aa, Artificial Sequence
  Core polypeptide
  SITE 23: Xaa = U (Aminobutyric Acid)
SKVLDLKNYIDKQLLPIVNKQSXSISNIETVIEFQ

SEQ ID NO: 1923 - protein, 35 aa, Artificial Sequence
  Core polypeptide
  SITE 22: Xaa = U (Aminobutyric Acid)
KVLDLKNYIDKQLLPIVNKQSXSISNIETVIEFQQ

SEQ ID NO: 1924 - protein, 35 aa, Artificial Sequence
  Core polypeptide
  SITE 21: Xaa = U (Aminobutyric Acid)
VLDLKNYIDKQLLPIVNKQSXSISNIETVIEFQQK

SEQ ID NO: 1925 - protein, 35 aa, Artificial Sequence
  Core polypeptide
  SITE 20: Xaa = U (Aminobutyric Acid)
LDLKNYIDKQLLPIVNKQSXSISNIETVIEFQQKN

SEQ ID NO: 1926 - protein, 35 aa, Artificial Sequence
  Core polypeptide
  SITE 19: Xaa = U (Aminobutyric Acid)
DLKNYIDKQLLPIVNKQSXSISNIETVIEFQQKNN

SEQ ID NO: 1927 - protein, 35 aa, Artificial Sequence
  Core polypeptide
  SITE 18: Xaa = U (Aminobutyric Acid)
LKNYIDKQLLPIVNKQSXSISNIETVIEFQQKNNR

SEQ ID NO: 1928 - protein, 35 aa, Artificial Sequence
  Core polypeptide
  SITE 17: Xaa = U (Aminobutyric Acid)
KNYIDKQLLPIVNKQSXSISNIETVIEFQQKNNRL

SEQ ID NO: 1929 - protein, 35 aa, Artificial Sequence
  Core polypeptide
  SITE 16: Xaa = U (Aminobutyric Acid)
NYIDKQLLPIVNKQSXSISNIETVIEFQQKNNRLL

SEQ ID NO: 1930 - protein, 35 aa, Artificial Sequence
  Core polypeptide
  SITE 15: Xaa = U (Aminobutyric Acid)
YIDKQLLPIVNKQSXSISNIETVIEFQQKNNRLLE

SEQ ID NO: 1931 - protein, 35 aa, Artificial Sequence
  Core polypeptide
  SITE 14: Xaa = U (Aminobutyric Acid)
IDKQLLPIVNKQSXSISNIETVIEFQQKNNRLLEI

SEQ ID NO: 1932 - protein, 35 aa, Artificial Sequence
  Core polypeptide
  SITE 13: Xaa = U (Aminobutyric Acid)
DKQLLPIVNKQSXSISNIETVIEFQQKNNRLLEIT

SEQ ID NO: 1933 - protein, 35 aa, Artificial Sequence
  Core polypeptide
  SITE 12: Xaa = U (Aminobutyric Acid)
KQLLPIVNKQSXSISNIETVIEFQQKNNRLLEITR

SEQ ID NO: 1934 - protein, 35 aa, Artificial Sequence
  Core polypeptide
  SITE 11: Xaa = U (Aminobutyric Acid)
QLLPIVNKQSXSISNIETVIEFQQKNNRLLEITRE

SEQ ID NO: 1935 - protein, 35 aa, Artificial Sequence
  Core polypeptide
  SITE 4: Xaa = Abu (aminobutyric acid)
DDEXLNSVKNGTYDFPKFEEESKLNRNEIKGVKLS

SEQ ID NO: 1936 - protein, 40 aa, Artificial Sequence; identical to SEQ ID NO: 1242
  Core polypeptide

SEQ ID NO: 1937 - protein, 40 aa, Artificial Sequence
  Core polypeptide
  SITE 4, 8: Xaa = Abu (aminobutyric acid)
YHKXDDEXLNSVKNGTFDFPKFEEESKLNRNEIKGVKLSS

SEQ ID NO: 1938 - protein, 36 aa, Artificial Sequence
  Core polypeptide
YTSLIHSLIEESQIQQEKNEQELLELDKWASLWNWF

SEQ ID NO: 1939 - protein, 36 aa, Artificial Sequence
  Core polypeptide
YTSLIHSLIEESQNQQEKNEYELLELDKWASLWNWF

SEQ ID NO: 1940 - protein, 36 aa, Artificial Sequence
  Core polypeptide
YTSLIHSLIEESQIQQEKNEYELLELDKWASLWNWF

SEQ ID NO: 1941 - protein, 36 aa, Artificial Sequence; identical to SEQ ID NO: 1252
  Core polypeptide

SEQ ID NO: 1942 - protein, 35 aa, Artificial Sequence
  Core polypeptide
WQEQEQKITALLEQAQIQQEKNEYELQKLDKEWWF

SEQ ID NO: 1943 - protein, 35 aa, Artificial Sequence
  Core polypeptide
WQEWEQKITALLEQAQIQQEKGEYELQKLDWQWEF

SEQ ID NO: 1944 - protein, 35 aa, Artificial Sequence
  Core polypeptide
WEQWEQKITALLEQAQIQQEKNEYELLELDKWEWF

SEQ ID NO: 1945 - protein, 40 aa, Artificial Sequence
  Core polypeptide
WQEWEQKITALLEQAQIQQEKNEYELEEELIEWASLWEWF

SEQ ID NO: 1946 - protein, 30 aa, Artificial Sequence
  Core polypeptide
WQEWQAQIQQEKNEYELQKLDKWASLWEWF

What is claimed is:

1. A method for identifying a compound that inhibits formation of or disrupts a DP107-like peptide/DP178-like peptide complex, said method comprising:
   (a) contacting, both in the presence and in the absence of a test compound,
      (i) a DP107-like peptide, wherein the DP107-like peptide is selected from the group consisting of DP107 (SEQ ID NO:16) and M41Δ178 (SEQ ID NO:1649), and
      (ii) a DP178-like peptide consisting of 16 to 39 amino acid residues in length, further comprising 16 to 36 amino acid residues of the DP178 amino acid sequence (SEQ ID NO:15), wherein the peptide has one, two or three amino acid residue substitutions to the DP178 sequence, further wherein the peptide has reduced binding affinity for the DP107-like peptide relative to that of DP178 (SEQ ID NO:15); and
   (b) determining the binding affinity of the DP178-like peptide and the DP107-like peptide in both the presence and in the absence of the test compound under conditions sufficient for binding of the peptides, wherein a lower binding affinity in the presence of the test compound indicates that the test compound inhibits formation of or disrupts a DP107-like/DP178-like complex, and wherein the DP107-like peptide and the DP-178-like peptide each comprise an amino acid sequence identified by one or more of the ALLMOTI5, 107×178×4 or PLZIP sequence search motifs.

2. The method of claim 1, wherein the binding affinities are determined by means of fluorescence polarization.

3. The method of claim 1, wherein the test compound is a peptide.

4. The method of claim 1, wherein the test compound is a small molecule.

5. A method for identifying a compound that inhibits formation of or disrupts a DP107-like peptide/DP178-like peptide complex, said method comprising:
   (a) contacting, both in the presence and the absence of a test compound,
      (i) a DP107-like peptide, wherein the DP107-like peptide is selected from the group consisting of DP107 (SEQ ID NO:16) and M41Δ178 (SEQ ID NO:1649), and
      (ii) a DP178-like peptide having reduced binding affinity for the DP107-like peptide relative to that of DP178 (SEQ ID NO:15), wherein the DP178-like peptide is selected from the group consisting of T1660 (SEQ ID NO:1515), T1661 (SEQ ID NO:1516), T1659 (SEQ ID NO:1514), T1631 (SEQ ID NO:1493), T1628 (SEQ ID NO:1490), T878 (SEQ ID NO:758), T870 (SEQ ID NO:750), T869 (SEQ ID NO:749), T868 (SEQ ID NO:748) and M41Δ107 (SEQ ID NO:1650); and
   (b) determining the binding affinity of the DP178-like peptide and the DP107-like peptide in both the presence and in the absence of the test compound under conditions sufficient for binding of the peptides, wherein a lower binding affinity in the presence of the test compound indicates that the test compound inhibits formation of or disrupts a DP107-like/DP178-like complex.

6. The method of claim 5, wherein the binding affinities are determined by means of fluorescence polarization.

7. The method of claim 5, wherein the test compound is a peptide.

8. The method of claim 5, wherein the test compound is a small molecule.

9. The method of claim 1, wherein the amino acid substitution is in a residue selected from the group consisting of residues at positions corresponding to $L_4$, $I_5$, $I_9$, $E_{20}$ and $L_{26}$ within the DP178 (SEQ ID NO:15) amino acid sequence.

10. The method of claim 9, wherein there is one amino acid substitution.

11. The method of claim 1, wherein the DP178-like peptide consists of an amino acid sequence of 36 amino acids in length.

12. The method of claim 11, wherein the amino acid substitution is in a residue selected from the group consisting of residues at positions corresponding to $L_4$, $I_5$, $I_9$, $E_{20}$ and $L_{26}$ within the DP178 (SEQ ID NO:15) amino acid sequence.

13. The method of claim 12, wherein there is one amino acid substitution.

14. A method for identifying a compound that inhibits formation of or disrupts a DP107-like peptide/DP178-like peptide complex, said method comprising:
   (a) contacting, both in the presence and in the absence of a test compound,
      (i) a DP107-like peptide, wherein the DP107-like peptide is selected from the group consisting of DP107 (SEQ ID NO:16) and M41Δ178 (SEQ ID NO:1649), and
      (ii) a DP178-like peptide having reduced binding affinity for the DP107-like peptide, wherein the DP178-like peptide possesses no less than one and no more than three amino acid substitutions in the amino acid sequence of peptide DP178 (SEQ ID NO:15); and
   (b) determining the binding affinity of the DP178-like peptide and the DP107-like peptide in both the presence and in the absence of the test compound under conditions sufficient for binding of the peptides, wherein a lower binding affinity in the presence of the test compound indicates that the test compound inhibits formation of or disrupts a DP107-like/DP178-like complex; and wherein the DP107-like peptide and the DP178-like peptide each consist of an amino acid sequence of between 16 and 39 amino acids identified by one or more of the ALLMOTI5, 107×178×4 or PLZIP sequence search motifs.

15. The method of claim 14, wherein the binding affinities are determined by means of fluorescence polarization.

16. The method of claim 14, wherein the test compound is a peptide.

17. The method of claim 14, wherein the test compound is a small molecule.

18. The method of claim 14, wherein the amino acid substitution is in a residue selected from the group consisting of residues at positions corresponding to $L_4$, $I_5$, $I_9$, $E_{20}$ and $L_{26}$ within the DP178 (SEQ ID NO:15) amino acid sequence.

19. The method of claim 18, wherein there is one amino acid substitution.

20. The method of claim 14, wherein the DP178-like peptide consists of an amino acid sequence of 36 amino acids in length.

21. The method of claim 20, wherein the amino acid substitution is in a residue selected from the group consisting of residues at positions corresponding to $L_4$, $I_5$, $I_9$, $E_{20}$ and $L_{26}$ within the DP178 (SEQ ID NO:15) amino acid sequence.

22. The method of claim 21, wherein there is one amino acid substitution.

* * * * *